US007608700B2

(12) United States Patent
Klaenhammer et al.

(10) Patent No.: US 7,608,700 B2
(45) Date of Patent: Oct. 27, 2009

(54) ***LACTOBACILLUS ACIDOPHILUS* NUCLEIC ACID SEQUENCES ENCODING STRESS-RELATED PROTEINS AND USES THEREFOR**

(75) Inventors: Todd R. Klaenhammer, Raleigh, NC (US); Eric Altermann, Apex, NC (US); M. Andrea Azcarate-Peril, Raleigh, NC (US); Olivia McAuliffe, Cork (IE); W. Michael Russell, Newburgh, IN (US)

(73) Assignee: North Carolina State University, Raleigh, NC (US)

( * ) Notice: Subject to any disclaimer, the term of this patent is extended or adjusted under 35 U.S.C. 154(b) by 262 days.

(21) Appl. No.: 11/074,176

(22) Filed: Mar. 7, 2005

(65) Prior Publication Data

US 2005/0250135 A1 Nov. 10, 2005

Related U.S. Application Data

(60) Provisional application No. 60/551,161, filed on Mar. 8, 2004.

(51) Int. Cl.

| | |
|---|---|
| ***C07H 21/04*** | (2006.01) |
| ***C12N 15/00*** | (2006.01) |
| ***C12N 1/00*** | (2006.01) |
| ***C12P 21/06*** | (2006.01) |
| ***C12P 21/04*** | (2006.01) |

(52) U.S. Cl. .................... 536/23.1; 536/23.7; 435/69.1; 435/69.7; 435/252.3; 435/320.1

(58) Field of Classification Search ....................... None
See application file for complete search history.

(56) References Cited

U.S. PATENT DOCUMENTS

| | | | | |
|---|---|---|---|---|
| 5,837,509 | A | 11/1998 | Israelsen et al. | |
| 6,451,584 | B2 | 9/2002 | Tomita et al. | |
| 6,476,209 | B1 | 11/2002 | Glenn et al. | |
| 6,544,772 | B1 | 4/2003 | Glenn et al. | |
| 6,562,958 | B1 * | 5/2003 | Breton et al. | 536/23.7 |
| 6,635,460 | B1 | 10/2003 | Van Hijum et al. | |
| 2002/0159976 | A1 | 10/2002 | Glenn et al. | |
| 2003/0138822 | A1 | 7/2003 | Glenn et al. | |
| 2004/0009490 | A1 | 1/2004 | Glenn et al. | |
| 2004/0208863 | A1 | 10/2004 | Versalovic et al. | |
| 2005/0003510 | A1 | 1/2005 | Chang et al. | |
| 2005/0112612 | A1 | 5/2005 | Klaenhammer | |
| 2005/0123941 | A1 | 6/2005 | Klaenhammer | |

FOREIGN PATENT DOCUMENTS

| | | | |
|---|---|---|---|
| EP | 0 888 118 | B1 | 1/1999 |
| WO | WO 02/12506 | A1 | 2/2002 |
| WO | WO 02/074798 | A2 | 9/2002 |
| WO | WO 03/084989 | A2 | 10/2003 |
| WO | WO 2004/020467 | A2 | 3/2004 |
| WO | WO 2004/031389 | A1 | 4/2004 |
| WO | WO 2004/069178 | A2 | 8/2004 |
| WO | WO 2004/096992 | A2 | 11/2004 |
| WO | WO 2005/001057 | A2 | 1/2005 |
| WO | WO 2005/012491 | A2 | 2/2005 |

OTHER PUBLICATIONS

Bowie et al (Science, 1990, 257:1306-1310).*

Journal of Molecular Microbiology and Biotechnology (2002), 4(6), 525-532), abstract only.*

Boehringer Mannheim Biochemicals (1991 Catalog p. 557); Stratagene (1991 Product Catalog, p. 66); Gibco BRL (Catalogue & Reference Guide 1992, p. 292).*

Promega (1993/1994 Catalog, pp. 90-91) ; New England BioLabs (Catalog 1986/1987, pp. 60-62).*

Abee et al. (1994) "Kinetic studies of the action of lactacin F, a bacteriocin produced by *Lactobacillus johnsonii* that forms poration complexes in the cytoplasmic membrane" *Appl. Environ. Microbiol.* 60:1006-1013.

Allison and Klaenhammer (1996) "Functional analysis of the gene encoding immunity to lactacin F, *lafI*, and its use as a *Lactobacillus*-specific, food-grade genetic marker" *Appl. Environ. Microbiol.* 62:4450-4460.

Allison and Klaenhammer (1999) "Genetics of bacterioncins produced by lactic acid bacteria and their use in novel industrial applications" in *Manual of Industrial Microbiology and Biotechnology*. DeMain and Davies (eds.), ASM Press, Washington, D.C., pp. 789-808.

Allison et al. (1994) "Expansion of bacteriocin activity and host range upon complementation of two peptides encoded with the lactacin F operon" *J. Bacteriol.* 176:2235-2241.

Altermann et al. (2004) "Identification and phenotypic characterization of the cell-division protein CdpA" *Gene* 342:189-197.

Altermann et al. (2005) "Complete genome sequence of the probiotic lactic acid bacterium *Lactobacillus acidophilus* NCFM" *Proc. Natl. Acad. Sci. U.S.A.* Early Edition 10.1073/pnas.0409188102, online publication date Jan. 25, 2005.

Azcarate-Peril et al. (2004) "Identification and inactivation of genetic loci involved with *Lactobacillus acidophilus* acid tolerance" *Appl. Environ. Microbiol.* 70:5315-5322.

Barefoot and Klaenhammer (1983) "Detection and activity of lactacin B, a bacteriocin produced by *Lactobacillus acidophilus*" *Appl. Environ. Microbiol.* 45:1808-1815.

(Continued)

*Primary Examiner*—Robert B Mondesi
*Assistant Examiner*—Padma V Baskar
(74) *Attorney, Agent, or Firm*—Alston & Bird LLP

(57) ABSTRACT

Stress-related nucleic acid molecules and polypeptides and fragments and variants thereof are disclosed in the current invention. In addition, stress-related fusion proteins, antigenic peptides, and anti-stress-related antibodies are encompassed. The invention also provides recombinant expression vectors containing a nucleic acid molecule of the invention and host cells into which the expression vectors have been introduced. Methods for producing the polypeptides and methods of use for the polypeptides of the invention are further disclosed.

11 Claims, 7 Drawing Sheets

OTHER PUBLICATIONS

Barefoot and Klaenhammer (1984) "Purification and characterization of the *Lactobacillus acidophilus* bacteriocin lactacin B" *Antimicrob. Agents Chemother*. 26:328-334.

Barefoot et al. (1994) "Identification and purification of a protein that induces production of the *Lactobacillus acidophilus* bacteriocin lactacin B" *Appl. Environ. Microbiol*. 60:3522-3528.

Barrangou et al. (2003) "Functional and comparative genomic analyses of an operon involved in fructooligosaccharide utilization by *Lactobacillus acidophilus" Proc. Natl. Acad. Sci. U.S.A*. 100:8957-8962.

Boels et al. (2001) "Functional analysis of the *Lactococcus lactis galU* and *galE* genes and their impact on sugar nucleotide and exopolysaccharide biosynthesis" *Appl. Environ. Microbiol*. 67:3033-3040.

Bruno-Barcena et al. (2004) "Expression of heterologous manganese superoxide dismutase gene in intestinal lactobacilli provides protection against hydrogen peroxide toxicity" *Appl. Environ. Microbiol*. 70:4702-4710.

Christensen et al. (1999) "Peptidases and Amino Acid Catabolism in Lactic Acid Bacteria" *Antonie van Leeuwenhoek* 76: 217-246.

Coconnier et al. (1992) "Protein-mediated adhesion of *Lactobacillus acidophilus* BG2FO4 on human enterocyte and mucus-secreting cell lines in culture" *Appl. Environ. Microbiol*. 58:2034-2039.

Contreras et al. (1997) "Isolation, purification and amino acid sequence of lactobin A, one of the two bacteriocins produced by *Lactobacillus amylovorus* LMG P-13139" *Appl. Environ. Microbiol*. 63:13-20.

De Vuyst and Degeest (1998) "Heteropolysaccharides from lactic acid bacteria" *FEMS Microbiol. Rev*. 23:153-177.

Dodd and Gasson (1994) "Bacteriocins of lactic acid bacteria" in *Genetics and Biotechnology of Lactic Acid Bacteria*. Gasson and de Vos (eds.), Blackie Academic and Professional, London, pp. 211-251.

Fremaux et al. (1993) "Molecular analysis of the lactacin F operon" *Appl. Environ. Microbiol*. 59:3906-3915.

GenBank Accession No. AAA19050; Prolinase; Source: *Lactobacillus helveticus*.

GenBank Accession No. AAA25250; Aminopeptidase C.; Source: *Lactobacillus helveticus*.

GenBank Accession No. AAB52540; Endopeptidase; Source: *Lactobacillus helveticus*.

GenBank Accession No. AAB66326; GroEL; Source: *Lactobacillus zeae*.

GenBank Accession No. AAC29003; cochaperonin GroES; Source: *Lactobacillus helveticus*.

GenBank Accession No. AAC99363; D-lactate dehydrogenase; Source: *Lactobacillus johnsonii*.

GenBank Accession No. AAF22492; F1F0-ATPase subunit a; Source: *Lactobacillus acidophilus*.

GenBank Accession No. AAF22493; F1F0-ATPase subunit c; Source: *Lactobacillus acidophilus*.

GenBank Accession No. AAF22494; F1F0-ATPase subunit b; Source: *Lactobacillus acidophilus*.

GenBank Accession No. AAF22495; F1F0-ATPase subunit delta; Source: *Lactobacillus acidophilus*.

GenBank Accession No. AAF22496; F1F0-ATPase subunit alpha; Source: *Lactobacillus acidophilus*.

GenBank Accession No. AAF22497; F1F0-ATPase subunit gamma; Source: *Lactobacillus acidophilus*.

GenBank Accession No. AAF22498; F1F0-ATPase subunit beta; Source: *Lactobacillus acidophilus*.

GenBank Accession No. AAF22499; F1F0-ATPase subunit epsilon; Source: *Lactobacillus acidophilus*.

GenBank Accession No. AAF75593; GroEL; Source: *Lactobacillus johnsonii*.

GenBank Accession No. AAK97217; cochaperonin GroES; Source: *Lactobacillus acidophilus*.

GenBank Accession No. AAK97218; chaperonin GroEL; Source: *Lactobacillus acidophilus*.

GenBank Accession No. AAK97220; cochaperonin GrpE; Source: *Lactobacillus acidophilus*.

GenBank Accession No. AAK97221; heat shock protein DnaK; Source: *Lactobacillus acidophilus*.

GenBank Accession No. AAQ72431; Endopeptidase E2; Source: *Lactobacillus helveticus*.

GenBank Accession No. AAR25444; Tuf; *Lactobacillus johnsonii*.

GenBank Accession No. AAT09141; amino acid permease La995; Source: *Lactobacillus acidophilus*.

GenBank Accession No. AF010281; *Lactobacillus zeae* GroES; Source: *Lactobacillus zeae*.

GenBank Accession No. AF031929; *Lactobacillus helveticus cochaperonin* GroES and chaperonin GroEL genes, complete cds and DNA mismatch repair enzyme (hexA) gene, partial cds; Source: *Lactobacillus helveticus*.

GenBank Accession No. AF071558; *Lactobacillus johnsonii* D-lactate dehydrogenase (ldhD) gene, complete cds; Source: *Lactobacillus johnsonii*.

GenBank Accession No. AF098522; *Lactobacillus acidophilus* uracil phosphoribosyltransferase; Source: *Lactobacillus acidophilus*.

GenBank Accession No. AF214488; *Lactobacillus johnsonii* groESL operon, complete sequence and unknown gene; Source: *Lactobacillus johnsonii*.

GenBank Accession No. AF300645; *Lactobacillus acidophilus* groESL operon, complete sequence; Source: *Lactobacillus acidophilus*.

GenBank Accession No. AF300646; *Lactobacillus acidophilus* repressor protein HrcA (hrcA) gene, partial cds; cochaperonin GrpE (grpE) and heat shock protein DnaK (dnaK) genes, complete cds, and DnaJ (dnaJ) gene, partical cds; Source: *Lactobacillus acidophilus*.

GenBank Accession No. B59088; Prolyl Aminopeptidase; Source: *Lactobacillus helveticus*.

GenBank Accession No. CAA42781; D-lactate dehydrogenase; Source: *Lactobacillus delbrueckii*.

GenBank Accession No. CAA59019; heat shock induced protein Htpl; Source: *Lactobacillus leichmannii*.

GenBank Accession No. CAA61561; SB-protein; *Lactobacillus acidophilus*.

GenBank Accession No. CAA86210; Dipeptidase; Source: *Lactobacillus helveticus*.

GenBank Accession No. CAB72938; Tripeptidase Enzyme; Source: *Lactobacillus helveticus*.

GenBank Accession No. NP_964658; probable xylulose-5-phosphate/fructose-6-phosphate phosphoketolase; Source: *Lactobacillus johnsonii NCC 533*.

GenBank Accession No. NP_964694; RecA protein; Source: *Lactobacillus johnsonii NCC 533*.

GenBank Accession No. NP_964728; phosphoglycerate kinase; Source: *Lactobacillus johnsonii NCC 533*.

GenBank Accession No. NP 964948; DNA-binding protein HU; Source: *Lactobacillus johnsonii NCC 533*.

GenBank Accession No. NP$_{13}$ 965314; 50S ribosomal protein L19; Source: *Lactobacillus johnsonii NCC 533*.

GenBank Accession No. NP_965472; thioredoxin; Source: *Lactobacillus johnsonii NCC 533*.

GenBank Accession No. NP_965500; hypothetical protein LJ1693; Source: *Lactobacillus johnsonii NCC 533*.

GenBank Accession No. O07684; Beta-galactosidase large subunit; Source: *Lactobacillus acidophilus*.

GenBank Accession No. O07685; Beta-galactosidase small subunit; Source: *Lactobacillus acidophilus*.

GenBank Accession No. O32755; Glyceraldehyde-3-phosphate dehydrogenase; Source: *Lactobacillus delbrueckii subsp. bulgaricus*.

GenBank Accession No. O32756; Phosphoglycerate kinase; Source: *Lactobacillus delbrueckii subsp. bulgaricus*.

GenBank Accession No. O32765; L-lactate dehydrogenase; Source: *Lactobacillus helveticus*.

GenBank Accession No. O68324; 60 kDa chaperonin; Source: *Lactobacillus helveticus*.

GenBank Accession No. O84913; Xaa-Pro dipeptidase; Source: *Lactobacillus helveticus*.

GenBank Accession No. P26297; D-lactate dehydrogenase; Source: *Lactobacillus delbrueckii subsp. bulgaricus*.

GenBank Accession No. P30901; D-lactate dehydrogenase; Source: *Lactobacillus helveticus*.
GenBank Accession No. P34038; Pyruvate kinase; Source: *Lactobacillus delbrueckii subsp. bulgaricus*.
GenBank Accession No. P35829; S-layer protein precursor; Source: *Lactobacilus acidophilus*.
GenBank Accession No. P43451; ATP synthase beta chain; Source: *Enterococcus hirae*.
GenBank Accession No. P94870; Aminopeptidase E.; Source: *Lactobacillus helveticus*.
GenBank Accession No. Q00052; Galactokinase; Source: *Lactobacillus helveticus*.
GenBank Accession No. Q10730; Aminopeptidase N; Source: *Lactobacillus helveticus*.
GenBank Accession No. Q10744; Aminopeptidase C.; Source: *Lactobacillus helveticus*.
GenBank Accession No. Q48558; Dipeptidase A.; Source: *Lactobacillus helveticus*.
GenBank Accession No. Q9Z4H7; Serine protease do-like htrA; Source: *Lactobacillus helveticus*.
GenBank Accession No. S47274; Membrane Alanyl Aminopeptidase; Source: *Lactobacillus helveticus*.
GenBank Accession No. S47276; Prolinase; Source: *Lactobacillus helveticus*.
GenBank Accession No. X60220; L. *delbrueckii* subsp. bulgaricus 1 dhA gene for D-lactate dehydrogenase; Source: *Lactobacillus delbrueckii*.
GenBank Accession No. X84261; *L.Leichmannii* xerC, hs1U and hsIV; Source: *Lactobacillus leichmannii*.
GenBank Accession No. X89376; *L. acidophilus* DNA for SB-protein gene; Source: *Lactobacillus acidophilus*.
GenBank Accession No. ZP_00046537; COG0124: Histidyl-tRNA synthetase; Source: *Lactobacillus gasseri*.
GenBank Accession No. ZP_00046557; COG0148: Enolase; Source: *Lactobacillus gasseri*.
GenBank Accession No. ZP_00046583; C0G0195: Transcription elongation factor; Source: *Lactobacillus gasseri*.
GenBank Accession No. ZP_00047305; C0G4690: Dipeptidase; Source: *Lactobacillus gasseri*.
GenBank Accession No. ZP_00341831; C060522: Ribosomal protein S4 and related proteins; Source: *Lactobacillus gasseri*.
GenBank Accession No. Q03234; ATP synthetase beta chain; *Lactobacillus casei*.
Girgis et al. (2002) "Stress adaptations of lactic acid bacteria" in *Microbial adaptation to stress and safety of new-generation foods*. Yousef and Juneja (eds.) CRC Press, NY, pp. 159-212.
Greene and Klaenhammer (1994) "Factors involved in adherence of lactobacilli to human Caco-2 cells" *Appl. Environ. Microbiol.* 60:4487-4494.
Holzapfel et al. (2001) "Taxonomy and Important Features of Probiotic Microorganisms in Food and Nutrition" *Am J of Clin Nutr* 73 Suppl: 365S-373S.
Hugenholtz et al. (1999) "Metabolic Engineering of Lactic Acid Bacteria: Overview of the Approaches and Results of Pathway Rerouting Involved in Food Fermentations" *Current Opinion in Biotechnology* 10: 492-497.
Joerger and Klaenhammer (1986) "Characterization and purification of helveticin J and evidence for a chromosomally determined bacteriocin produced by *Lactobacillus helveticus" J. Bacteriol.* 167:439-446.
Joerger et al. (1990) "Cloning, expression, and nucleotide sequence of the *Lactobacillus helveticus* 481 gene encoding the bactericin helveticin J" *J. Bacteriol*. 172:6339-6347.
Jolly et al. (2002) "Exploiting exopolysaccharides from lactic acid bacteria" *Antonie van Leeuwenhoek* 82:367-374.
Klaenhammer (1988) "Bacteriocins of lactic acid bacteria" *Biochimie* 70:337-349.
Klaenhammer (1993) "Genetics of bacteriocins produced by lactic acid bacteria" *FEMS Microbiol. Rev.* 12:39-85.
Klaenhammer (2000) "Probiotic bacteria: today and tomorrow" *J. Nutr*. 130(2S Suppl.):415S-416S.
Klaenhammer and Kullen (1999) "Selection and design of probiotics" *Int. J. Food Microbiol*. 50:45-57.
Klaenhammer and Sutherland (1980) "Detection of plasmid deoxyribonucleic acid in an isolate of *Lactobacillus acidophilus" Appl. Environ. Microbiol*. 39:671-674.
Klaenhammer et al. (2002) "Discovering lactic acid bacteria by genomics" *Antonie van Leeuwenhoek* 82:29-58.
Kleeman and Klaenhammer (1982) "Adherence of *Lactobacillus* species to human fetal intestinal cells" *J. Dairy Sci*. 65:2063-2069.
Kleerebezem et al. (1999) "Exopolysaccharides produced by *Lactococcus lactis*: from genetic engineering to improved rheological properties?" *Antonie van Leeuwenhoek* 76:357-365.
Kleerebezem et al. (2003) "Complete genome sequence of *Lactobacillus plantarum* WCFS1" *Proc. Natl. Acad. Sci. U.S.A.* 100:1990-1995.
Kok et al. "The Proteolytic System of Lactic Acid Bacteria" *Genetics and Biotechnology of Lactic Acid Bacteria* pp. 169-210, M. Gasson and W.M. DeVos, Eds., Blackie and Professional, London, England (1994).
Konigs et al. (1997) "The role of transport processes in survival of lactic acid bacteria" *Antonie van Leeuwenhoek* 71:117-128.
Konigs et al. (2000) "Lactic acid bacteria: the bugs of the new millennium" *Curr. Opin. Microbiol*. 3:276-282.
Kuipers et al. (2000) "Current Strategies for Improving Food Bacteria" *Res Microbiol* 151: 815-822.
Kullen and Klaenhammer (1999) Identification of the pH-inducible, proton-translocating $F_1F_0$-ATPase (atpBEFHAGDC) operon of *Lactobacillus acidophilus* by differential display: gene structure, cloning and characterization *Mol. Microbiol*. 33:1152-1161.
Kullen and Klaenhammer (2000) "Genetic modification of intestinal lactobacilli and bifidobacteria" *Curr. Issues Mol. Biol*. 2:41-50.
Kullen et al. (2000) "Use of the DNA sequence of variable regions of the 16S rRNA gene for rapid and accurate identification of bacteria in the *Lactobacillus acidophilus* complex" *J. Appl. Microbiol*. 89:511-516.
Law et al. (1997) "Proteolytic Enzymes of Lactic Acid Bacteria" *Int Dairy Journal* 7: 1-11.
Luchansky et al. (1988) "Application of electroporation for transfer of plasmid DNA to *Lactobacillus, Lactococcus, Leuconostoc, Listeria, Pediococcus; Bacillus, Staphylococcus, Enterococcus and Propionobacterium*" *Mol. Microbiol*. 2:637-646.
Luchansky et al. (1989) "Genetic transfer systems for delivery of plasmid deoxyribonucleic acid to *Lactobacillus acidophilus* ADH: conjugation, electroporation, and transduction" *J. Dairy Sci*. 72:1408-1417.
Luchansky et al. (1991) "Molecular cloning and deoxyribonucleic acid polymorphisms in *Lactobacillus acidophilus* and *Lactobacillus gasseri" J. Dairy Sci*. 74:3293-3302.
Majhenic et al. (2004) "DNA analysis of the genes encoding acidocin LF221 A and acidocin LF221 B, two bacteriocins produced by *Lactobacillus gasseri* LF221" *Appl. Microbiol. Biotechnol*. 63:705-714.
Mohamadzadeh et al. (2005) "*Lactobacilli* activate human dendritic cells that skew T cells toward T helper 1 polarization" *Proc. Nat. Acad. Sci. USA* 102:2880-2885.
Muriana and Klaenhammer (1991) "Cloning, phenotypic expression, and DNA sequence of the gene for lactacin F, an antimicrobial peptide produced by *Lactobacillus spp." J. Bacteriol*. 173: 1779-1788.
Muriana and Klaenhammer (1991) "Purification and partial characterization of lactacin F, a bacteriocin produced by *Lactobacillus acidophilus* 11088" *Appl. Environ. Microbiol*. 57:114-121.
Pao et al. (1998) "Major Facilitator Superfamily" *Microbiol. Mal. Biol. Rev*. 62:1-34.
Poolman (2002) "Transporters and their roles in LAB cell physiology" *Antonie van Leeuwenhoek* 82:147-164.
Pridmore et al. (2004) "The genome sequence of the probiotic intestinal bacterium *Lactobacillus johnsonii* NCC 533" *Proc. Natl. Acad. Sci. U.S.A.* 101:2512-2517.
Putman et al. (2000) "Molecular properties of bacterial multidrug transporters" *Microbiol. Mol. Biol. Rev*. 64:672-693.
Rastall et al. (2005). Modulation of the microbial ecology of the human colon by probiotics, prebiotics and synbiotics to enhance human health: An overview of enabling science and potential applications. *FEMS Microbiol. Ecol*. 52:145-152.

Roy et al. (1993) "Cloning and expression of the manganese superoxide dismutase gene of *Escherichia coli* in *Lactococcus lactis* and *Lactobacillus gasseri" Mol. Gen. Genet.* 239:33-40.
Russell and Klaenhammer (2001) "Efficient system for directed integration into the *Lactobacillus acidophilus* and *Lactobacillus gasseri* chromosomes via homologous recombination" *Appl. Environ. Microbiol.* 67:4361-4364.
Russell and Klaenhammer (2001) "Identification and cloning of *gus*A, encoding a new β-glucuronidase from *Lactobacillus gasseri* ADH" *Appl. Environ. Microbiol.* 67:1253-1261.
Sablon et al. (2000) "Antimicrobiol peptides of lactic acid bacteria: mode of action, genetics and biosynthesis" in *Advances in Biochemical Engineering/Biotechnology*. vol. 68. Schleper (ed.), Springer-Verlag, Berlin, pp. 21-60.
Sanders and Klaenhammer (2001) "Invited review: the scientific basis of *Lactobacillus acidophilus* NCFM functionality as a probiotic" *J. Dairy Sci.* 84:319-331.
Sanders et al. (1996) "Performance of commercial cultures in fluid milk applications" *J. Dairy Sci.* 79:943-955.
Steidler et al. (1998) "Functional display of a heterologous protein on the surface of *Lactococcus lactis* by means of the cell wall anchor of *Staphylococcus aureus* protein A" *Appl. Environ. Microbiol.* 64:342-345.
Sturino and Klaenhammer (2004) "Bacteriophage defense systems for lactic acid bacteria" *Adv. Appl. Microbiol.* 56:331-378.
Ventura et al. (2003) "Analysis, characterization, and loci of the *tuf* genes in *Lactobacillus and Bifidobacterium* species and their direct application for species identification" *Appl. Environ. Microbiol.* 69:6908-6922.
Walker et al. (1999) "The *groESL* chaperone operon of *Lactobacillus johnsonii" Appl. Environ. Microbiol.* 65:3033-3041.
Yother et al. (2002) Genetics of streptococci, lactococci, and enterococci: review of the sixth international conference *J. Bacteriol.* 184:6085-6092 frutooligosaccharide utilization by *Lactobacillus acidophilus Proc. Natl. Acad. Sci. U.S.A.* 100:8957-8962.
Boels et al. (2001) "Functional analysis of the *Lactococcus lactis gal*U and *gal*E genes and their impact on sugar nucleotide and exopolysaccharide biosynthesis" *Appl. Environ. Microbiol.* 67:3033-3040.
Bruno-Barcena et al. (2004) "Expression of heterologous manganese superoxide dismutase gene in intestinal lactobacilli provides protection against hydrogen peroxide toxicity" *Appl. Environ. Microbiol.* 70:4702-4710.
Christensen et al. (1999) "Peptidases and Amino Acid Catabolism in Lactic Acid Bacteria" *Antonie van Leeuwenhoek* 76: 217-246.
Coconnier et al. (1992) "Protein-mediated adhesion of *Lactobacillus acidophilus* BG2FO4 on human enterocyte and mucus-secreting cell lines in culture" *Appl. Environ. Microbiol.* 58:2034-2039.
Contreras et al. (1997) "Isolation, purification and amino acid sequence of lactobin A, one of the two bacteriocins produced by *Lactobacillus amylovorus* LMG P-13139" *Appl. Environ. Microbiol.* 63:13-20.
De Vuyst and Degeest (1998) "Heteropolysaccharides from lactic acid bacteria" *FEMS Microbiol. Rev.* 23:153-177.
Dodd and Gasson (1994) "Bacteriocins of lactic acid bacteria" in *Genetics and Biotechnology of Lactic Acid Bacteria*. Gasson and de Vos (eds.), Blackie Academic and Professional, London, pp. 211-251.
Fremaux et al. (1993) "Molecular analysis of the lactacin F operon" *Appl. Environ. Microbiol.* 59:3906-3915.
GenBank Accession No. AAA 19050; Prolinase; Source: *Lactobacillus helveticus*, filed Jan. 17, 1994.
GenBank Accession No. AAA25250; Aminopeptidase C.; Source: *Lactobacillus helveticus*filed Jan. 13, 1994.
GenBank Accession No. AAB52540; Endopeptidase; Source: *Lactobacillus helveticus* filed Nov. 1, 1996.
GenBank Accession No. AAB66326; GroEL; Source: *Lactobacillus zeae*, filed Aug. 7, 1997.
GenBank Accession No. AAC29003; cochaperonin GroES; Source: *Lactobacillus helveticus* filed Aug. 7, 1998.
GenBank Accession No. AAC99363; D-lactate dehydrogenase; Source: *Lactobacillus johnsonii* filed Sep. 10, 1999.
GenBank Accession No. AAF22492; F1F0-ATPase subunit a; Source: *Lactobacillus acidophilus*filed Aug. 30, 2001.
GenBank Accession No. AAF22493 ; F1F0-ATPase subunit c; Source: *Lactobacillus acidophilus* filed Aug. 30, 2001.
GenBank Accession No. AAF22494; F1F0-ATPase subunit b; Source: *Lactobacillus acidophilus* filed Aug. 30, 2001.
GenBank Accession No. AAF22495; F1OF-ATPase subunit delta; Source: *Lactobacillus acidophilus* filed Aug. 30, 2001.
GenBank Accession No. AAF22496; F1F0-ATPase subunit alpha; Source: *Lactobacillus acidophilus* filed Aug. 30, 2001.
GenBank Accession No. AAF22497; F1F0-ATPase subunit gamma; Source: *Lactobacillus acidophilus* filed Aug. 30, 2001.
GenBank Accession No. AAF22498; F1F0-ATPase subunit beta; Source: *Lactobacillus acidophilus* filed Aug. 30, 2001.
GenBank Accession No. AAF22499; F1F0-ATPase subunit epsilon; Source: *Lactobacillus acidophilus* filed Aug. 30, 2001.
GenBank Accession No. AAF75593; GroEL; Source: *Lactobacillus johnsonii* filed Jun. 13, 2000.
GenBank Accession No. AAK97217; cochaperonin GroES; Source: *Lactobacillus acidophilus* filed Sep. 2, 2001.
GenBank Accession No. AAK97218; chaperonin GroEL; Source: *Lactobacillus acidophilus* filed Sep. 2, 2001.
GenBank Accession No. AAK97220; cochaperonin GrpE; Source: *Lactobacillus acidophilus*, filed Sep. 2, 2001.
GenBank Accession No. AAK97221; heat shock protein DnaK; Source: *Lactobacillus acidophilus* filed Sep. 2, 2001.
GenBank Accession No. AAQ72431; Endopeptidase E2; Source: *Lactobacillus helveticus* filed Aug. 11, 2003.
GenBank Accession No. AAR25444; Tuf; *Lactobacillus johnsonii* filed Dec. 3, 2003.
GenBank Accession No. AAT09141; amino acid permease La995; Source: *Lactobacillus acidophilus* filed Sep. 7, 2004.
GenBank Accession No. AF010281; *Lactobacillus zeae* GroES; Source: *Lactobacillus zeae* filed Aug. 9, 1997.
GenBank Accession No. AF031929; *Lactobacillus helveticus cochaperottin* GroES and chaperonin GroEL genes, complete cds and DNA mismatch repair enzyme (hexA) gene, partial cds; Source: *Lactobacillus helveticus* filed Aug. 8, 1998.
GenBank Accession No. AF071558; *Lactobacillus johnsonii* D-lactate dehydrogenase (IdhD) gene, complete cds; Source: *Lactobacillus johnsonii* filed Sep. 10, 1999.
GenBank Accession No. AF098522; *Lactobacillus acidophilus* uracil phosphoribosyltransferase; Source: *Lactobacillus acidophilus* filed Sep. 30, 2001.
GenBank Accession No. AF214488; *Lactobacillus johnsonii* groESL operon, complete sequence and unknown gene; Source: *Lactobacillus johnsonii* filed Jun. 13, 2000.
GenBank Accession No. AF300645; *Lactobacillus acidophilus* groESL operon, complete sequence; Source: *Lactobacillus acidophilus* filed Sep. 2, 2001.
GenBank Accession No. AF300646; Lactobacillus acidophilus repressor protein HrcA (hrcA) gene, partial cds; cochaperonin GrpE (grpE) and heat shock protein DnaK (dnaK) genes, complete cds, and DnaJ (dnaJ) gene, partical cds; Source: *Lactobacillus acidophilus* filed Sep. 2, 2001.
GenBank Accession No. B59088; Prolyl Aminopeptidase; Source: *Lactobacillus helveticus* filed Oct. 22, 1999.
GenBank Accession No. CAA42781; D-lactate dehydrogenase; Source: *Lactobacillus delbrueckii* filed Nov. 5, 1992.
GenBank Accession No. CAA59019; heat shock induced protein HtpI; Source: *Lactobacillus leichmannii* filed Apr. 18, 2005.
GenBank Accession No. CAA61561; SB-protein; *Lactobacillus acidophilus* filed Jan. 22, 1996.
GenBank Accession No. CAA86210; Dipeptidase; Source: *Lactobacillus helveticus* filed Oct. 10, 1994.
GenBank Accession No. CAB72938; Tripeptidase Enzyme; Source: *Lactobacillus helveticus* filed Jun. 23, 1999.
GenBank Accession No. NP_964658; probable xylulose-5-phosphate/fructose-6-phosphate phosphoketolase; Source: *Lactobacillus johnsonii NCC 533* , filed Jan. 26, 2007.
GenBank Accession No. NP_964694; RecA protein; Source: *Lactobacillus johnsonii NCC 533* , filed Jan. 26, 2007.

GenBank Accession No. NP_964728; phosphoglycerate kinase; Source: *Lactobacillus johnsonii NCC 533* filed Jan. 26, 2007.
GenBank Accession No. NP_964948; DNA-binding protein HU; Source: *Lactobacillus johnsonii NCC 533* filed Jan. 26, 2007.
GenBank Accession No. NP_965314; 50S ribosomal protein L19; Source: *Lactobacillus johnsonii NCC 533* filed Jan. 26, 2007.
GenBank Accession No. NP_965472; thioredoxin; Source: *Lactobacillus johnsonii NCC 533* filed Jan. 26, 2007.
GenBank Accession No. NP_965500; hypothetical protein LJ1693; Source: *Lactobacillus johnsonii NCC 533* filed Jan. 26, 2007.
GenBank Accession No. O07684; Beta-galactosidase large subunit; Source: *Lactobacillus acidophilus* filed Oct. 17, 2006.
GenBank Accession No. O07685; Beta-galactosidase small subunit; Source: *Lactobacillus acidophilus* filed Nov. 28, 2006.
GenBank Accession No. O32755; Glyceraldehyde-3-phosphate dehydrogenase; Source: *Lactobacillus delbrueckii subsp. bulgaricus* filed Oct. 17, 2006.
GenBank Accession No. O32756; Phosphoglycerate kinase; Source: *Lactobacillus delbrueckii subsp. bulgaricus* filed Apr. 18, 2006.
GenBank Accession No. O32765; L-lactate dehydrogenase; Source: *Lactobacillus helveticus* filed Nov. 28, 2006.
GenBank Accession No. O68324; 60 kDa chaperonin; Source: *Lactobacillus helveticus* filed Mar. 21, 2006.
GenBank Accession No. O84913; Xaa-Pro dipeptidase; Source: *Lactobacillus helveticus* filed Jul. 1, 1997.
GenBank Accession No. P26297; D-lactate dehydrogenase; Source: *Lactobacillus delbrueckii subsp. bulgaricus* filed Jan. 23, 2007.
GenBank Accession No. P30901; D-lactate dehydrogenase; Source: *Lactobacillus helveticus* filed Jan. 23, 2007.
GenBank Accession No. P34038; Pyruvate kinase; Source: *Lactobacillus delbrueckii subsp. bulgaricus* filed Nov. 28, 2006.
GenBank Accession No. P35829; S-layer protein precursor; Source: *Lactobacilus acidophilus* filed Jan. 9, 2007.
GenBank Accession No. P43451; ATP synthase beta chain; Source: *Enterococcus hirae* filed Oct. 17, 2006.
GenBank Accession No. P94870; Aminopeptidase E.; Source: *Lactobacillus helveticus* filed May 1, 1997.
GenBank Accession No. Q00052; Galactokinase; Source: *Lactobacillus helveticus* filed Mar. 21, 2006.
GenBank Accession No. Q10730; Aminopeptidase N; Source: *Lactobacillus helveticus* filed Oct. 1, 1996.
GenBank Accession No. QI0744; Aminopeptidase C.; Source: *Lactobacillus helveticus* filed Nov. 1, 1996.
GenBank Accession No. Q48558; Dipeptidase A.; Source: *Lactobacillus helvetictis* filed Sep. 26, 2001.
GenBank Accession No. Q9Z4H7; Serine protease do-like htrA; Source: *Lactobacillus helveticus* filed Oct. 17, 2006.
GenBank Accession No. S47274; Membrane Alanyl Aminopeptidase; Source: *Lactobacillus helveticus* filed Feb. 1, 1994.
GenBank Accession No. S47276; Prolinase; Source: *Lactobacillus helveticus* filed Jan. 6, 1995.
GenBank Accession No. X60220; *L. delbrueckii* subsp. bulgaricus IdhA gene for D-lactate dehydrogenase; Source: *Lactobacillus delbrueckii* filed Nov. 5, 1992.
GenBank Accession No. X84261; *L.Leichmannii* xerC, hslU and hslV; Source: *Lactobacillus leichmannii* filed Apr. 18, 2005.
GenBank Accession No. X89376; *L. acidophilus* DNA for SB-protein gene; Source: *lactobacillus acidophilus* filed Jan. 22, 2006.
GenBank Accession No. ZP_00046537; COG0124: Histidyl-tRNA synthetase; Source: *Lactobacillis gasseri* filed May 25, 2006.
GenBank Accession No. ZP_00046557; COG0148: Enolase; Source: *Lactobacillus gasseri* filed May 25, 2006.
GenBank Accession No. ZP_00046583; COG0195: Transcription elongation factor; Source: *Lactobacillus gasseri* filed May 25, 2006.
GenBank Accession No. ZP_00047305; COG4690: Dipeptidase; Source: *Lactobacillus gasseri* filed May 25, 2006.
GenBank Accession No. ZP_00341831; COG0522: Ribosomal protein S4 and related proteins; Source: *Lactobacillus gasseri* filed May 25, 2006.
GenBank Accession No. Q03234; ATP synthetase beta chain; *Lactobacillus casei* filed Oct. 17, 2006.
Rallu, F., et al., "Acid- and Multistress-Resistant Mutants of Lactococcus Lactis:—Identification of Intracellular Stress Signals," *Molecular Microbiology*, 2000, pp. 517528.

* cited by examiner

A.

B.

C.

*LACTOBACILLUS ACIDOPHILUS* NUCLEIC ACID SEQUENCES ENCODING STRESS-RELATED PROTEINS AND USES THEREFOR

CROSS REFERENCE TO RELATED APPLICATION

This application claims the benefit of U.S. Provisional Application Ser. No. 60/551,161, filed Mar. 8, 2004, the contents of which are herein incorporated by reference in their entirety.

INCORPORATION OF SEQUENCE LISTING ON COMPACT DISK

The entire contents of the compact disk filed in identical duplicate herewith and containing one file entitled "5051.694 Sequence Listing" (1,481 kb; created Mar. 4, 2005) is incorporated by reference herein.

FIELD OF THE INVENTION

This invention relates to polynucleotides isolated from lactic acid bacteria, namely *Lactobacillus acidophilus*, and polypeptides encoded by them, as well as methods for using the polypeptides and organisms expressing them.

BACKGROUND OF THE INVENTION

*Lactobacillus acidophilus* is a Gram-positive, rod-shaped, non-spore forming, homofermentative bacterium that is a normal inhabitant of the gastrointestinal and genitourinary tracts. Since its original isolation by Moro (1900) from infant feces, the "acid loving" organism has been found in the intestinal tract of humans, breast-fed infants, and persons consuming high milk, lactose, or dextrin diets. Historically, *L. acidophilus* is the *Lactobacillus* species most often implicated as an intestinal probiotic capable of eliciting beneficial effects on the microflora of the gastrointestinal tract (Klaenhammer and Russell (2000) "Species of the *Lactobacillus acidophilus* complex" *Encyclopedia of Food Microbiology,* 2:1151-1157. Robinson et al., eds. (Academic Press, San Diego, Calif.)). *L. acidophilus* can ferment hexoses, including lactose and more complex oligosaccharides, to produce lactic acid and lower the pH of the environment where the organism is cultured. Acidified environments (e.g., food, vagina, and regions within the gastrointestinal tract) can interfere with the growth of undesirable bacteria, pathogens, and yeasts. The organism is well known for its acid tolerance, survival in cultured dairy products, and viability during passage through the stomach and gastrointestinal tract. *Lactobacilli* and other commensal bacteria, some of which are considered as probiotic bacteria that "favor life," have been studied extensively for their effects on human health, particularly in the prevention or treatment of enteric infections, diarrheal disease, prevention of cancer, and stimulation of the immune system. Genetic characterization of other *Lactobacillus* species (e.g., *L. johnsonii* and *L. rhamnosus*) has been described (see e.g., U.S. Pat. No. 6,476,209; U.S. Pat. No. 6,544,772; U.S. Patent Publication Nos. 20020159976, 2003013882 & 20040009490; PCT Publication No. WO 2004/031389; PCT Publication No. 2003/084989; PCT Publication No. WO 2004/020467).

During fermentation, lactic acid bacteria are exposed to toxic byproducts of their growth, such as lactic acid and hydrogen peroxide, antimicrobial agents produced by neighboring microorganisms, and deleterious environmental conditions required for proper fermentation of a raw food item. They must also adapt to harsh conditions found in the stomach during ingestion, and severe temperatures associated with storage or production conditions. These bacteria have evolved complex stress response mechanisms to permit their survival under adverse conditions such as heat or cold shock, acid or alkaline shock, osmotic or oxidative stress, and/or starvation.

Microorganisms that can better withstand stressful environments, such as those present during commercial fermentation and storage, are advantageous. Therefore, isolated nucleic acid sequences encoding such stress-related proteins are desirable for use in engineering microorganisms, including *Lactobacillus acidophilus*, to have an increased ability to tolerate various stress conditions.

BRIEF SUMMARY OF THE INVENTION

Compositions and methods for modifying *Lactobacillus* organisms are provided. Compositions of the invention include isolated nucleic acids from *Lactobacillus acidophilus* encoding stress-related proteins, including heat and cold shock proteins, acid and alkaline tolerance proteins, osmotic and oxidative stress-related proteins and starvation-induced proteins. Specifically, the present invention provides isolated nucleic acid molecules comprising, consisting essentially of and/or consisting of the nucleotide sequence as set forth in odd numbered SEQ ID NOS:1-365, singly and/or in any combination, and isolated nucleic acid molecules encoding the amino acid sequence as set forth found in even numbered SEQ ID NOS:2-370, singly and/or in any combination. Also provided are isolated and/or recombinant polypeptides comprising, consisting essentially of and/or consisting of an amino acid sequence encoded by a nucleic acid molecule described herein and/or as set forth in even numbered SEQ ID NOS:2-370, singly and/or in any combination. Variant nucleic acid molecules and polypeptides sufficiently identical to the nucleotide sequences and amino acid sequences set forth in the Sequence Listing are encompassed by the present invention. Additionally, fragments and sufficiently identical fragments of the nucleotide sequences and amino acid sequences are encompassed. Nucleotide sequences that are complementary to a nucleotide sequence of this invention, and/or that hybridize to a nucleotide sequence of the invention, are also encompassed.

Compositions further include vectors and prokaryotic, eukaryotic and plant cells comprising the vectors and/or nucleic acids of this invention for recombinant expression of the nucleic acid molecules described herein, as well as transgenic microbial populations comprising the vectors. Also included in the invention are methods for the recombinant production of the polypeptides of the invention, and methods for their use. Further included are methods and kits for detecting the presence of a nucleic acid and/or polypeptide of this invention in a sample, and antibodies that specifically bind to a polypeptide of the invention. Biologically pure cultures of bacteria comprising a nucleotide sequence and/or amino acid sequence of the present invention are encompassed. Food containing these cultures are encompassed, including, but not limited to, milk, yogurt, curd, cheese, fermented milks, ice-creams, fermented cereal based products, milk based powders, infant formulae, tablets, liquid bacterial suspensions, dried oral supplement, and liquid oral supplements.

The stress-related molecules of the present invention are useful for the selection and production of recombinant bacteria, particularly the production of bacteria with improved fermentative abilities. Such bacteria include, but are not limited to, those better able to withstand heat and cold, acid and alkaline conditions, non-optimal osmotic or oxidative conditions, and/or starvation.

Compositions and methods for modifying *Lactobacillus* organisms are provided. Compositions of the invention include isolated nucleic acids selected from the group consisting of: a) a nucleic acid molecule comprising, consisting essentially of and/or consisting of a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367 and/or 369 (odd numbered SEQ ID NOS:1-369) in any combination, or a complement thereof; b) a nucleic acid molecule comprising, consisting essentially of and/or consisting of a nucleotide sequence having at least 90% sequence identity to a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367 and/or 369 in any combination, or a complement thereof; c) a nucleic acid molecule comprising, consisting essentially of and/or consisting of a fragment of a nucleotide sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367 and/or 369 in any combination, or a complement thereof, d) a nucleic acid molecule that encodes a polypeptide comprising, consisting essentially of and/or consisting of an amino acid sequence of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368 and/or 370 (even numbered SEQ ID NOS:2-370) in any combination; e) a nucleic acid molecule comprising a nucleotide sequence encoding a polypeptide having at least 90% amino acid sequence identity to the amino acid sequence of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368 and/or 370 in any combination; and f) a nucleic acid molecule that hybridizes under stringent conditions to a nucleic acid of (a)-(e).

Compositions of this invention further include vectors comprising the nucleic acids of the invention, and vectors further comprising a nucleic acid encoding a heterologous polypeptide, as well as a cell that contains a vector of the invention. In an embodiment, the cell comprising a vector of the invention can be a bacterial cell.

Additional compositions include a polypeptide selected from the group consisting of: a) a polypeptide comprising, consisting essentially of and/or consisting of an amino acid sequence as set forth in SEQ ID NOs:2-370, singly and/or in any combination; b) a polypeptide comprising a fragment of an amino acid sequence as set forth in any of SEQ ID NOs: 2-370, singly and/or in any combination; c) a polypeptide having at least 90% sequence identity to an amino acid sequence as set forth in any of SEQ ID NOs:2-370, singly and/or in any combination; d) a polypeptide encoded by a nucleotide sequence having at least 90% sequence identity to a nucleotide sequence as set forth in any of SEQ ID NOs:1-369, singly and/or in any combination; and e) a polypeptide encoded by a nucleotide sequence as set forth in any of SEQ ID NOs:1-369, singly and/or in any combination.

Compositions also provided herein include a polypeptide of the invention further comprising one or more heterologous amino acid sequences, and antibodies that selectively bind to a polypeptide of the invention.

Additionally provided herein are methods for producing a polypeptide, comprising culturing a cell of the invention under conditions in which a nucleic acid molecule encoding a polypeptide of this invention is expressed, said polypeptide being selected from the group consisting of: a) a polypeptide comprising an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368 and/or 370 in any combination; b) a polypeptide comprising a fragment of an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368 and/or 370 in any combination; c) a polypeptide comprising an amino acid sequence having at least 90% sequence identity with an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368 and/or 370 in any combination; d) a polypeptide encoded by a nucleotide sequence having at least 90% sequence identity to a nucleotide sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367 and/or 369 in any combination; and e) a polypeptide encoded by a nucleotide sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367 and/or 369.

Additionally provided are methods for detecting the presence of a polypeptide in a sample comprising contacting the sample with a compound that selectively binds to a polypeptide and determining whether the compound binds to the polypeptide in the sample; wherein said polypeptide is selected from the group consisting of: a) a polypeptide encoded by a nucleotide sequence as set forth in any of SEQ ID NOs:1-369, singly and/or in any combination; b) a polypeptide comprising a fragment of an amino acid sequence encoded by a nucleic acid sequence as set forth in any of SEQ ID NOs:1-369, singly and/or in any combination; c) a polypeptide encoded by a nucleic acid sequence having at least 90% sequence identity to a nucleotide sequence of any of SEQ ID NOs:1-369, singly and/or in any combination; d) a polypeptide comprising an amino acid sequence having at least 90% sequence identity to an amino acid sequence of any of SEQ ID NOs:2-370, singly and/or in any combination; e) a polypeptide comprising the amino acid sequence as set forth in any of SEQ ID NOs: 2-370, singly and/or in any combination; and f) a fragment of a polypeptide comprising the amino acid sequence as set forth in any of SEQ ID NOs:2-370, singly and/or in any combination.

Further provided are methods for detecting the presence of a polypeptide in a sample wherein the compound that binds to the polypeptide is an antibody, as well as kits comprising a compound for use in methods of the invention for detecting the presence of a polypeptide in a sample and instructions for use.

The present invention also provides methods for detecting the presence of a nucleic acid molecule and/or fragments thereof, of this invention in a sample, comprising: a) contacting the sample with a nucleic acid probe or primer that selectively hybridizes to the nucleic acid molecule and/or fragment thereof; and b) determining whether the nucleic acid probe or primer hybridizes to a nucleic acid molecule in the sample, thereby detecting the presence of a nucleic acid molecule and/or fragment thereof of this invention in the sample. Also provided are methods for detecting the presence of a nucleic acid molecule and/or fragment of the invention in a sample wherein the sample comprises mRNA molecules and is contacted with a nucleic acid probe. Additionally provided herein is a kit comprising a compound that selectively hybridizes to a nucleic acid of the invention, and instructions for use.

Further provided herein are methods 1) for increasing the ability of an organism to survive stressful conditions; 2) for increasing the ability of an organism to survive heat shock conditions; 3) for increasing the ability of an organism to survive cold shock conditions; 4) for increasing the ability of an organism survive acidic conditions; 5) for enhancing the ability of an organism to survive passage through the gastrointestinal tract; 6) for increasing the ability of an organism to survive alkaline conditions; 7) for increasing the ability of an organism to survive osmotic stress; 8) for increasing the ability of an organism to survive oxidative stress; and 9) for increasing the ability of an organism to survive starvation conditions, comprising introducing into said organism a vector comprising at least one nucleotide sequence of this invention and/or at least one nucleotide sequence selected from the group consisting of: a) a nucleotide sequence as set forth in any of SEQ ID NOs:1-369, singly and/or in any combination; b) a nucleotide sequence comprising a fragment of the nucleotide sequence as set forth in any of SEQ ID NOs:1-369, singly and/or in any combination, wherein said fragment encodes a polypeptide that retains activity; c) a nucleotide sequence that is at least 90% identical to the nucleotide sequence as set forth in any of SEQ ID NOs:1-369, singly and/or in any combination; d) a nucleotide sequence encoding a polypeptide comprising an amino acid sequence having at least 90% sequence identity to an amino acid sequence as set forth in any of SEQ ID NOs:2-370, singly and/or in any combination, wherein said polypeptide retains activity; e) a nucleotide sequence encoding a polypeptide comprising an amino acid sequence as set forth in any of SEQ ID NOs:2-370, singly and/or in any combination, wherein said polypeptide retains activity; and f) a nucleotide sequence encoding a polypeptide comprising a fragment of an amino acid sequence as set forth in any of SEQ ID NOs:2-370, singly and/or in any combination, wherein said fragment retains activity.

Additionally provided are methods for increasing the ability of an organism to survive heat shock conditions, comprising introducing into said organism a vector and/or at least one nucleotide sequence of the invention encoding a heat shock protein selected from the group consisting of class I genes, class II genes, class III genes, and/or class IV genes.

Further provided are methods for increasing the ability of an organism to survive heat shock conditions, comprising introducing into said organism a vector and/or at least one nucleotide sequence of the invention encoding a heat shock protein from class I genes, wherein said class I genes are from the dnaK operon and/or from the groE operon.

Even further provided are methods for increasing the ability of an organism to survive heat shock conditions, comprising introducing into said organism a vector and/or at least one nucleotide sequence of the invention encoding a heat shock protein from class I genes, wherein said genes are homologues of dnaK, grpE, hrcA, dnaJ, groES, and/or groEL genes.

Additionally provided are methods for increasing the ability of an organism to survive heat shock conditions, comprising introducing into said organism a vector and/or at least one nucleotide sequence of the invention encoding a heat shock protein from class III genes, wherein said class III genes are homologues of clpB, clpC, clpE, clpX, and/or clpP genes.

Also provided are methods for increasing the ability of an organism to survive heat shock conditions, comprising introducing into said organism a vector and/or at least one nucleotide sequence of the invention encoding a heat shock protein from class IV genes, wherein said class IV genes are homologues of ftsH, hsp18, lonA, and/or htpG genes.

In addition, methods are provided herein for increasing the ability of an organism to survive cold shock conditions, comprising introducing into said organism a vector and/or at least one nucleotide sequence of the invention, wherein said nucleotide sequence encodes a cold-stress protein that can be a cold shock protein, a cold-induced protein, and/or a cold acclimation protein.

Further provided are methods for increasing the ability of an organism to survive cold shock conditions, comprising introducing into said organism a vector and/or at least one nucleotide sequence of the invention encoding a cold stress protein, wherein said cold-stress protein is a homologue of a cspA, cspB, cspC, cspD, cspE, cspF, cspG, gyrA, hns, cspL, and/or cspP gene.

Methods are also provided herein for increasing the ability of a organism to survive acidic conditions, comprising introducing into said organism a vector and/or at least one nucleotide sequence of the invention, wherein said nucleotide sequence is a gene in the atp operon, a gene involved in the arginine deaminase pathway, a gene in the gadCB operon, and/or a gene involved in citrate transport.

Further provided are methods for increasing the ability of an organism to survive osmotic stress, comprising introducing into said organism a vector and/or at least one nucleotide sequence of the invention, wherein said nucleotide sequence encodes an osmotic stress-related protein involved in transport of glycine betaine.

Also provided are methods for increasing the ability of an organism to survive oxidative stress, comprising introducing into said organism a vector and/or at least one nucleotide sequence of the invention, wherein said nucleotide sequence encodes an oxidative stress-related protein that can be NADH oxidase, an NADH peroxidase, glutaredoxin, thioredoxin, a catalase, a superoxide dismutase, and/or RecA.

Yet another embodiment of the invention provides 1) a *Lactobacillus acidophilus* bacterial strain with an increased ability to survive stressful conditions as compared to a wild-type *Lactobacillus acidophilus*, wherein said increased ability to survive stressful conditions is due to overexpression of a nucleotide sequence as set forth below; 2) a *Lactobacillus acidophilus* bacterial strain with an increased ability to survive heat shock as compared to a wild-type *Lactobacillus acidophilus*, wherein said increased ability to survive heat shock is due to overexpression of a nucleotide sequence as set forth below; 3) a *Lactobacillus acidophilus* bacterial strain with an increased ability to survive cold shock as compared to a wild-type *Lactobacillus acidophilus*, wherein said increased ability to survive cold shock is due to overexpression of a nucleotide sequence as set forth below; 4) a *Lactobacillus acidophilus* bacterial strain with an increased ability to survive acidic conditions as compared to a wild-type *Lactobacillus acidophilus*, wherein said increased ability to survive acidic conditions is due to overexpression of a nucleotide sequence as set forth below; 5) a *Lactobacillus acidophilus* bacterial strain with an increased ability to survive alkaline conditions as compared to a wild-type *Lactobacillus acidophilus*, wherein said increased ability to survive alkaline conditions is due to overexpression of a nucleotide sequence as set forth below; 6) a *Lactobacillus acidophilus* bacterial strain with an increased ability to survive osmotic stress as compared to a wild-type *Lactobacillus acidophilus*, wherein said increased ability to survive osmotic stress is due to overexpression of a nucleotide sequence as set forth below; 7) a *Lactobacillus acidophilus* bacterial strain with an increased ability to survive oxidative stress as compared to a wild-type *Lactobacillus acidophilus*, wherein said increased ability to survive oxidative stress is due to overexpression of a nucleotide sequence as set forth below; and 8) a *Lactobacillus acidophilus* bacterial strain with an increased ability to survive starvation conditions as compared to a wild-type *Lactobacillus acidophilus*, wherein said increased ability to survive starvation conditions is due to overexpression of a nucleotide sequence as set forth below.

Each of the methods set forth above includes overexpression of a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367 and/or 369 in any combination and/or overexpression of a nucleotide sequence encoding an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368 and/or 370 in any combination.

BRIEF DESCRIPTION OF THE DRAWINGS

FIG. 2A shows ORF 57 (SEQ ID NO:1) and surrounding genes. FIG. 2B shows the gene organization of the region containing ORF 995 (SEQ ID NOS:59 and 315) and ORF 996 (SEQ ID NO:61). FIG. 2C shows the gene organization of the region containing ORF 867 (SEQ ID NO:51). Disrupted genes are represented by gray arrows. Putative rho-independent terminators and their calculated free energy are indicated. Potential functions based on homologies are indicated.

FIG. 3A shows a diagram of the ORF 57 (SEQ ID NO:1) locus of NCFM and NCK1678 chromosomes. ORF 57 (SEQ ID NO:1) is represented by an arrow and the internal fragment is denoted by a shaded box. The restriction sites PstI, BamHI, and BglII are indicated. The repeating unit represents the plasmid DNA present in various copies (n). FIG. 3B shows Southern hybridization analysis of NCFM and NCK1678 (ORF 57 (SEQ ID NO:1). Chromosomal DNA was digested with BglII (lane 1, plasmid pTRK803; lane 2, NCFM; lanes 3 and 4, NCK1678). The internal fragment was used as the probe. FIGS. 3C and 3D show PCR amplification of the left (3C) and right (3D) junction fragments in NCK1678. Lane 1, 1-kb ladder; lane 2, NCFM; lanes 3 and 4, NCK1678 (ORF 57 (SEQ ID NO:1). Em, erythromycin.

DETAILED DESCRIPTION OF THE INVENTION

Figure 1:
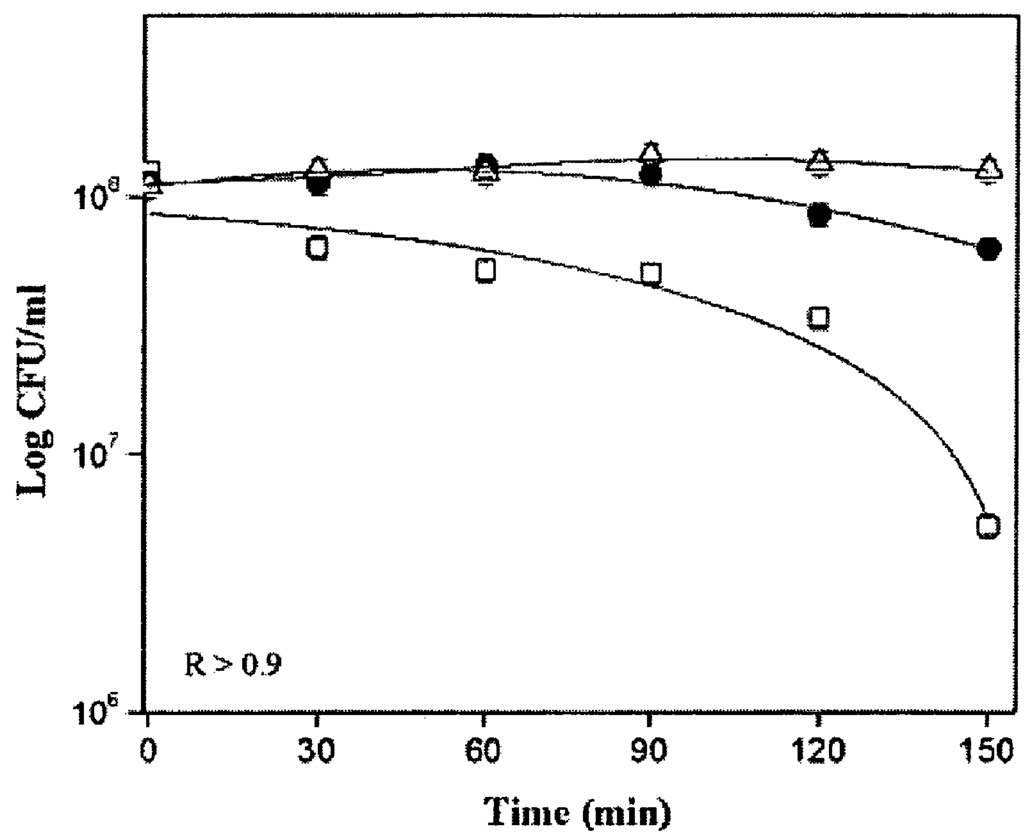
FIG. 1 shows the survival of *L. acidophilus* NCK1398 exposed to MRS broth adjusted to pH 3.0 (with HCl) and pH 3.5 (with lactic acid) and incubated at 37° C. Symbols: ●, adapted (1 h, pH 5.5) cells exposed to pH 3.5; □, nonadapted cells exposed to pH 3.5; Δ, nonadapted cells exposed to pH 3.0.

As used herein, "a," "an" and "the" can be plural or singular as used throughout the specification and claims. For example "a" cell can mean a single cell or a multiplicity of cells.

Also as used herein, "and/or" refers to and encompasses any and all possible combinations of one or more of the associated listed items, as well as the lack of combinations when interpreted in the alternative ("or").

The present invention relates to stress-related molecules from *Lactobacillus acidophilus*. By "stress-related molecules" or "stress-related proteins" is intended proteins or the nucleic acid sequences encoding them that allow an organism to better survive stressful conditions such as non-optimal temperatures, pH, osmolarity, nutrient compositions, and the like. These proteins include, but are not limited to, heat shock proteins; cold stress proteins, including cold shock proteins, cold-induced proteins, and cold acclimation proteins; acid tolerance proteins; alkaline tolerance proteins; osmotic stress-related proteins; oxidative stress-related proteins; and starvation-induced proteins. Examples of genes encoding stress-related proteins are found in Table 1. Specific stress-related proteins included in the present invention can be found in Table 2.

The stress-related molecules of the present invention are stress-related molecules from *L. acidophilus*. The full length gene sequences are referred to as "stress-related sequences," showing that they have similarity to stress-related genes. The invention further provides fragments and variants of these stress-related sequences, which can also be used to practice the methods of the present invention. As used herein, the terms "gene" and "recombinant gene" refer to nucleic acid molecules comprising an open reading frame, particularly those encoding a stress-related protein. Isolated nucleic acid molecules of the present invention comprise nucleic acid sequences encoding stress-related proteins, nucleic acid sequences encoding the amino acid sequences set forth in even SEQ ID NOS:2-370, the nucleic acid sequences set forth in odd SEQ ID NOS:1-369, and variants and fragments thereof. The present invention also encompasses antisense nucleic acid molecules, as described below.

In addition, isolated polypeptides and proteins having stress-related protective activity, and variants and fragments thereof, are encompassed, as well as methods for producing those polypeptides. For purposes of the present invention, the terms "protein" and "polypeptide" are used interchangeably. One amino acid sequence included in the present invention is found in SEQ ID NO:2. The polypeptides of the present invention have stress-related protective activity. "Stress-related protective activity" or "stress-related activity" refers to a biological or functional activity as determined in vivo or in vitro according to standard assay techniques. These techniques could involve, for example, measuring bacterial survival or growth under adverse environmental conditions. (See, for example, Varcamonti et al. (2003) *Appl. Environ. Microbiol.* 69: 1287-1289). By "adverse environmental conditions" or "stressful environmental conditions" is intended an environmental condition or state that is not conducive for growth of the microorganism, and includes, but is not limited to, heat shock conditions, cold shock conditions, acidic conditions, alkaline conditions, non-optimal osmotic stress conditions, non-optimal oxidative stress conditions, and starvation conditions. In one embodiment, the activity is the ability of a microorganism to survive heat shock.

The nucleic acid and protein compositions encompassed by the present invention are isolated or substantially purified. By "isolated" or "substantially purified" is intended that the nucleic acid or protein molecules, or biologically active fragments or variants, are substantially or essentially free from components normally found in association with the nucleic acid or protein in its natural state. Such components include other cellular material, culture media from recombinant production, and various chemicals used in chemically synthesizing the proteins or nucleic acids. Preferably, an "isolated" nucleic acid of the present invention is free of nucleic acid sequences that flank the nucleic acid of interest in the genomic DNA of the organism from which the nucleic acid was derived (such as coding sequences present at the 5' or 3' ends). However, the molecule may include some additional bases or moieties that do not deleteriously affect the basic characteristics of the composition. For example, in various embodiments, the isolated nucleic acid contains less than 5 kb, 4 kb, 3 kb, 2 kb, 1 kb, 0.5 kb, or 0.1 kb of nucleic acid sequence normally associated with the genomic DNA in the cells from which it was derived. Similarly, a substantially purified protein has less than about 30%, 20%, 10%, 5%, or 1% (by dry weight) of contaminating protein, or non-stress-related protein. When the protein is recombinantly produced, preferably culture medium represents less than 30%, 20%, 10%, or 5% of the volume of the protein preparation, and when the protein is produced chemically, preferably the preparations have less than about 30%, 20%, 10%, or 5% (by dry weight) of chemical precursors, or non-stress-related chemicals.

The compositions and methods of the present invention can be used to modulate the function of the stress-related molecules of *L. acidophilus*. By "modulate," "alter," or "modify" is intended the up- or down-regulation of a target biological activity, particularly the up-regulation of activity. Proteins of the invention are useful in modifying the biological activities of lactic acid bacteria, especially lactic acid bacteria that are used to ferment foods with nutritional or health-promoting characteristics. Nucleotide molecules of the invention are useful in modulating stress-related protein expression by lactic acid bacteria. Up- or down-regulation of expression from a polynucleotide of the present invention is encompassed. Up-regulation may be accomplished by providing multiple gene copies, modulating expression by modifying regulatory elements, promoting transcriptional or translational mechanisms, or other means. Down-regulation may be accomplished by using known antisense and gene silencing techniques.

By "lactic acid bacteria" is intended bacteria of a genus selected from the following: *Aerococcus, Carnobacterium, Enterococcus, Lactococcus, Lactobacillus, Leuconostoc, Oenococcus, Pediococcus, Streptococcus, Melissococcus, Alloiococcus, Dolosigranulum, Lactosphaera, Tetragenococcus, Vagococcus*, and *Weissella* (Holzapfel et al. (2001) *Am. J. Clin. Nutr.* 73:365S-373S; *Bergey's Manual of Systematic Bacteriology*, Vol. 2 (Williams and Wilkins, Baltimore (1986)) pp. 1075-1079).

Microbes expressing the polypeptides of the present invention are useful as additives in dairy and fermentation processing. The polynucleotide sequences, encoded polypeptides, and microorganisms expressing them are useful in the manufacture of milk-derived products, such as cheeses, yogurt, fermented milk products, sour milks, and buttermilk. Microorganisms that express polypeptides of the invention may be probiotic organisms. By "probiotic" is intended a live microorganism that survives passage through the gastrointestinal tract and has a beneficial effect on the subject. By "subject" is intended an organism that comes into contact with a microorganism expressing a protein of the present invention. Subject may refer to humans and other animals.

In addition to the stress-related nucleotide sequences disclosed herein, and fragments and variants thereof, the isolated nucleic acid molecules of the current invention also encompass homologous DNA sequences identified and isolated from other organisms or cells by hybridization with entire or partial sequences obtained from the stress-related nucleotide sequences disclosed herein, or variants and fragments thereof.

Fragments and Variants

The invention provides isolated nucleic acid molecules comprising nucleotide sequences encoding stress-related proteins, as well as the stress-related proteins encoded thereby. By "stress-related protein" is intended proteins having the amino acid sequences set forth in even SEQ ID NOS: 2-370. Fragments and variants of these nucleotide sequences and encoded proteins are also provided. By "fragment" of a nucleotide sequence or protein is intended a portion of the nucleotide or amino acid sequence.

Fragments of the nucleic acid molecules disclosed herein can be used as hybridization probes to identify stress-related protein-encoding nucleic acids, or can be used as primers in PCR amplification or mutation of stress-related nucleic acid molecules. Fragments of nucleic acids can also be bound to a physical substrate to comprise what may be considered a macro- or microarray (for example, U.S. Pat. No. 5,837,832; U.S. Pat. No. 5,861,242). Such arrays of nucleic acids may be used to study gene expression or to identify nucleic acid molecules with sufficient identity to the target sequences.

The present invention further provides a nucleic acid array or chip, i.e., a multitude of nucleic acids (e.g., DNA) as molecular probes precisely organized or arrayed on a solid support, which allow for the sequencing of genes, the study of mutations contained therein and/or the analysis of the expression of genes, as such arrays and chips are currently of interest given their very small size and their high capacity in terms of number of analyses.

The function of these nucleic acid arrays/chips is based on molecular probes, mainly oligonucleotides, which are attached to a carrier having a size of generally a few square centimeters or more, as desired. For an analysis, the carrier, such as in a DNA array/chip, is coated with DNA probes (e.g., oligonucleotides) that are arranged at a predetermined location or position on the carrier. A sample containing a target nucleic acid and/or fragments thereof to be analyzed, for example DNA or RNA or cDNA, that has been labeled beforehand, is contacted with the DNA array/chip leading to the formation, through hybridization, of a duplex. After a washing step, analysis of the surface of the chip allows any hybridizations to be located by means of the signals emitted by the labeled target. A hybridization fingerprint results, which, by computer processing, allows retrieval of information such as the expression of genes, the presence of specific fragments in the sample, the determination of sequences and/or the identification of mutations.

In one embodiment of this invention, hybridization between target nucleic acids and nucleic acids of the invention, used in the form of probes and deposited or synthesized in situ on a DNA chip/array, can be determined by means of fluorescence, radioactivity, electronic detection or the like, as are well known in the art.

In another embodiment, the nucleotide sequences of the invention can be used in the form of a DNA array/chip to carry out analyses of the expression of *Lactobacillus acidophilus* genes. This analysis is based on DNA array/chips on which probes, chosen for their specificity to characterize a given gene or nucleotide sequence, are present. The target sequences to be analyzed are labeled before being hybridized onto the chip. After washing, the labeled complexes are detected and quantified, with the hybridizations being carried out at least in duplicate. Comparative analyses of the signal intensities obtained with respect to the same probe for different samples and/or for different probes with the same sample, allows, for example, for differential transcription of RNA derived from the sample.

In yet another embodiment, arrays/chips containing nucleotide sequences of the invention can comprise nucleotide sequences specific for other microorganisms, which allows for serial testing and rapid identification of the presence of a microorganism in a sample.

In a further embodiment, the principle of the DNA array/chip can also be used to produce protein arrays/chips on which the support has been coated with a polypeptide and/or an antibody of this invention, or arrays thereof, in place of the nucleic acid. These protein arrays/chips make it possible, for example, to analyze the biomolecular interactions induced by the affinity capture of targets onto a support coated, e.g., with proteins, by surface plasma resonance (SPR). The polypeptides or antibodies of this invention, capable of specifically binding antibodies or polypeptides derived from the sample to be analyzed, can be used in protein arrays/chips for the detection and/or identification of proteins and/or peptides in a sample.

Thus, the present invention provides a microarray or microchip comprising various nucleic acids of this invention in any combination, including repeats, as well as a microarray comprising various polypeptides of this invention in any combination, including repeats. Also provided is a microarray comprising one or more antibodies that specifically react with various polypeptides of this invention, in any combination, including repeats.

By "nucleic acid molecule" is intended DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA. A fragment of a nucleic acid molecule encoding a stress-related protein may encode a protein fragment that is biologically active, or it may be used as a hybridization probe or PCR primer as described below. A biologically active fragment of a polypeptide disclosed herein can be prepared by isolating a portion of one of the nucleotide sequences of the invention, expressing the encoded portion of the stress-related protein (e.g., by recombinant expression in vitro), and assessing the activity of the encoded portion of the stress-related protein. Fragments of nucleic acid molecules encoding stress-related proteins comprise at least about 15, 20, 50, 75, 100, 200, 250, 300, 350, 400, 450, 500, 550, 600, 650, 700, 750, 800, 850, 900, 950, 1000 nucleotides or up to the total number of nucleotides present in a full-length stress-related nucleotide sequence as disclosed herein (for example, 1440 for SEQ ID NO:1, 1269 for SEQ ID NO:3, etc.).

Fragments of amino acid sequences include polypeptide fragments suitable for use as immunogens to raise anti-stress-related antibodies. Fragments include peptides comprising amino acid sequences sufficiently identical to or derived from the amino acid sequence of a stress-related protein, or partial-length protein, of the invention and exhibiting at least one activity of a stress-related protein, but which include fewer amino acids than the full-length stress-related proteins disclosed herein. Typically, biologically active portions comprise a domain or motif with at least one activity of the stress-related protein. A biologically active portion of a stress-related protein can be a polypeptide that is, for example, 10, 25, 50, 100, 150, 200 contiguous amino acids in length, or up to the total number of amino acids present in a full-length stress-related protein of the current invention (for example, 480 for SEQ ID NO:2, 423 for SEQ ID NO:4, etc.). Such biologically active portions can be prepared by recombinant techniques and evaluated for one or more of the functional activities of a native stress-related protein. As used here, a fragment comprises at least 5 contiguous amino acids of even SEQ ID NOS:2-370. The invention encompasses other fragments, however, such as any fragment in the protein greater than 6, 7, 8, or 9 amino acids.

Variants of the nucleotide and amino acid sequences are encompassed in the present invention. By "variant" is intended a sufficiently identical sequence. Accordingly, the invention encompasses isolated nucleic acid molecules that are sufficiently identical to the nucleotide sequences encoding stress-related proteins in even SEQ ID NOS:2-370, or nucleic acid molecules that hybridize to a nucleic acid molecule of odd SEQ ID NOS:1-369, or a complement thereof, under stringent conditions. Variants also include variant polypeptides encoded by the nucleotide sequences of the present invention. In addition, polypeptides of the current invention have an amino acid sequence that is sufficiently identical to an amino acid sequence put forth in even SEQ ID NOS:2-370. By "sufficiently identical" is intended that one amino acid sequence or nucleotide sequence contains a sufficient or minimal number of equivalent or identical amino acid residues or nucleotides as compared to a second amino acid sequence or nucleotide sequence, thus providing a common structural domain and/or indicating a common functional activity. Conservative variants include those nucleotide sequences that differ due to the degeneracy of the genetic code.

In general, amino acid sequences or nucleotide sequences that have at least about 45%, 55%, or 65% identity, preferably at least about 70% or 75% identity, more preferably at least about 80%, 85% or 90%, most preferably at least about 91%, 92%, 93%, 94%, 95%, 95%, 96%, 97%, 98%, 99%, or 99.5% sequence identity to any of the amino acid sequences of even SEQ ID NOS:2-370 or any of the nucleotide sequences of odd SEQ ID NOS:1-365, respectively, are defined herein as sufficiently identical. Variant proteins encompassed by the present invention are biologically active, that is they retain the desired biological activity of the native protein, that is, providing increased cell survival in stressful environmental conditions, as described herein. See, for example, Varcamonti et al. (2003) *Appl. Environ. Microbiol.* 69: 1287-1289. A biologically active variant of a protein of the invention may differ from that protein by as few as 1-15 amino acid residues, as few as 1-10, such as 6-10, as few as 5, as few as 4, 3, 2, or even 1 amino acid residue.

Naturally occurring variants may exist within a population (e.g., the *L. acidophilus* population). Such variants can be identified by using well-known molecular biology techniques, such as the polymerase chain reaction (PCR), and hybridization as described below. Synthetically derived nucleotide sequences, for example, sequences generated by site-directed mutagenesis or PCR-mediated mutagenesis that still encode a stress-related protein, are also included as variants. One or more nucleotide or amino acid substitutions, additions, or deletions can be introduced into a nucleotide or amino acid sequence disclosed herein, such that the substitutions, additions, or deletions are introduced into the encoded protein. The additions (insertions) or deletions (truncations) may be made at the N-terminal or C-terminal end of the native protein, or at one or more sites in the native protein. Similarly, a substitution of one or more nucleotides or amino acids may be made at one or more sites in the native protein.

For example, conservative amino acid substitutions may be made at one or more predicted, preferably nonessential amino acid residues. A "nonessential" amino acid residue is a residue that can be altered from the wild-type sequence of a protein without altering the biological activity, whereas an "essential" amino acid is required for biological activity. A "conservative amino acid substitution" is one in which the amino acid residue is replaced with an amino acid residue with a similar side chain. Families of amino acid residues having similar side chains are known in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Such substitutions would not be made for conserved amino acid residues, or for amino acid residues residing within a conserved motif, where such residues are essential for protein activity.

Alternatively, mutations can be made randomly along all or part of the length of the stress-related coding sequence, such as by saturation mutagenesis. The mutants can be expressed recombinantly, and screened for those that retain biological activity by assaying for stress-related protective activity using standard assay techniques. Methods for mutagenesis and nucleotide sequence alterations are known in the art. See, for example, Kunkel (1985) *Proc. Natl. Acad. Sci. USA* 82:488-492; Kunkel et al. (1987) *Methods in Enzymol. Molecular Biology* (MacMillan Publishing Company, New York) and the references sited therein. Obviously the mutations made in the DNA encoding the variant must not disrupt the reading frame and preferably will not create complimentary regions that could produce secondary mRNA structure. See, EP Patent Application Publication No. 75,444. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays. That is, the activity can be evaluated by comparing the activity of the modified sequence with the activity of the original sequence. See, for example, Varcamonti et al. (2003) *Appl. Environ. Microbiol.* 69: 1287-1289, herein incorporated by reference.

Variant nucleotide and amino acid sequences of the present invention also encompass sequences derived from mutagenic and recombinogenic procedures such as DNA shuffling. With such a procedure, one or more different stress-related protein coding regions can be used to create a new stress-related protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the stress-related gene of the invention and other known stress-related genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

Variants of the stress-related proteins can function as either stress-related agonists (mimetics) or as stress-related antagonists. An agonist of the stress-related protein can retain substantially the same, or a subset, of the biological activities of the naturally occurring form of the stress-related protein. An antagonist of the stress-related protein can inhibit one or more of the activities of the naturally occurring form of the stress-related protein by, for example, competitively binding to a downstream or upstream member of a cellular signaling cascade that includes the stress-related protein.

Variants of a stress-related protein that function as either agonists or antagonists can be identified by screening combinatorial libraries of mutants, e.g., truncation mutants, of a stress-related protein for stress-related protein agonist or antagonist activity. In one embodiment, a variegated library of stress-related variants is generated by combinatorial mutagenesis at the nucleic acid level and is encoded by a variegated gene library. A variegated library of stress-related variants can be produced by, for example, enzymatically ligating a mixture of synthetic oligonucleotides into gene sequences such that a degenerate set of potential stress-related sequences is expressible as individual polypeptides, or alternatively, as a set of larger fusion proteins (e.g., for phage display) containing the set of stress-related sequences therein. There are a variety of methods that can be used to produce libraries of potential stress-related variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential stress-related sequences. Methods for synthesizing degenerate oligonucleotides are known in the art (see, e.g., Narang (1983) *Tetrahedron* 39:3; Itakura et al. (1984) *Annu. Rev. Biochem.* 53:323; Itakura et al. (1984) *Science* 198:1056; Ike et al. (1983) *Nucleic Acids Res.* 11:477).

In addition, libraries of fragments of a stress-related protein coding sequence can be used to generate a variegated population of stress-related fragments for screening and subsequent selection of variants of a stress-related protein. In one embodiment, a library of coding sequence fragments can be generated by treating a double-stranded PCR fragment of a stress-related coding sequence with a nuclease under conditions wherein nicking occurs only about once per molecule, denaturing the double-stranded DNA, renaturing the DNA to form double-stranded DNA which can include sense/antisense pairs from different nicked products, removing single-stranded portions from reformed duplexes by treatment with S1 nuclease, and ligating the resulting fragment library into an expression vector. By this method, one can derive an expression library that encodes N-terminal and internal fragments of various sizes of the stress-related protein.

Several techniques are known in the art for screening gene products of combinatorial libraries made by point mutations or truncation and for screening cDNA libraries for gene products having a selected property. Such techniques are adaptable for rapid screening of the gene libraries generated by the combinatorial mutagenesis of stress-related proteins. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique that enhances the frequency of functional mutants in the libraries, can be used in combination with the screening assays to identify stress-related variants (Arkin and Yourvan (1992) *Proc. Natl. Acad. Sci. USA* 89:7811-7815; Delgrave et al. (1993) *Protein Engineering* 6(3):327-331).

Sequence Identity

The stress-related sequences are members of a family of molecules with conserved functional features. By "family" is intended two or more proteins or nucleic acid molecules having sufficient nucleotide sequence or amino acid sequence identity. A family that contains deeply divergent groups may be divided into subfamilies. A clan is a group of families that are thought to have common ancestry. Members of a clan often have a similar tertiary structure. By "sequence identity" is intended the nucleotide or amino acid residues that are the same when aligning two sequences for maximum correspondence over at least one specified comparison window. By "comparison window" is intended a contiguous segment of the two nucleotide sequences or amino acid sequences for optimal alignment, wherein the second sequence may contain additions or deletions (i.e., gaps) as compared to the first sequence. Generally, for nucleic acid alignments, the comparison window is at least 20 contiguous nucleotides in length, and optionally can be 30, 40, 50, 100, or longer. For amino acid sequence alignments, the comparison window is at least 6 contiguous amino acids in length, and optionally can be 10, 15, 20, 30, or longer. Those of skill in the art understand that to avoid a high similarity due to inclusion of gaps, a gap penalty is typically introduced and is subtracted from the number of matches.

Family members may be from the same or different species, and can include homologues as well as distinct proteins. Often, members of a family display common functional characteristics. Homologues can be isolated based on their identity to the *Lactobacillus acidophilus* stress-related nucleic acid sequences disclosed herein using the cDNA, or a portion thereof, as a hybridization probe according to standard hybridization techniques under stringent hybridization conditions as disclosed below.

To determine the percent identity of two amino acid or nucleotide sequences, an alignment is performed. Percent identity of the two sequences is a function of the number of identical residues shared by the two sequences in the comparison window (i.e., percent identity=number of identical residues/total number of residues×100). In one embodiment, the sequences are the same length. Methods similar to those mentioned below can be used to determine the percent identity between two sequences. The methods can be used with or without allowing gaps. Alignment may also be performed manually by inspection.

When amino acid sequences differ in conservative substitutions, the percent identity may be adjusted upward to correct for the conservative nature of the substitution. Means for making this adjustment are known in the art. Typically the conservative substitution is scored as a partial, rather than a full mismatch, thereby increasing the percentage sequence identity.

Mathematical algorithms can be used to determine the percent identity of two sequences. Non-limiting examples of mathematical algorithms are the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877; the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; and the search-for-local alignment-method of Pearson and Lipman (1988) *Proc. Natl. Acad. Sci. USA* 85:2444-2448.

Various computer implementations based on these mathematical algorithms have been designed to enable the determination of sequence identity. The BLAST programs of Altschul et al. (1990) *J. Mol. Biol.* 215:403 are based on the algorithm of Karlin and Altschul (1990) supra. Searches to obtain nucleotide sequences that are homologous to nucleotide sequences of the present invention can be performed with the BLASTN program, score=100, wordlength=12. To obtain amino acid sequences homologous to sequences encoding a protein or polypeptide of the current invention, the BLASTX program may be used, score=50, wordlength=3. Gapped alignments may be obtained by using Gapped BLAST (in BLAST 2.0) as described in Altschul et al. (1997) *Nucleic Acids Res.* 25:3389. To detect distant relationships between molecules, PSI-BLAST can be used. See Altschul et al. (1997) supra. For all of the BLAST programs, the default parameters of the respective programs can be used. See www.ncbi.nlm.nih.gov. Alignment may also be performed manually by inspection.

Another program that can be used to determine percent sequence identity is the ALIGN program (version 2.0), which uses the mathematical algorithm of Myers and Miller (1988) supra. A PAM120 weight residue table, a gap length penalty of 12, and a gap penalty of 4 can be used with this program when comparing amino acid sequences.

In addition to the ALIGN and BLAST programs, the BESTFIT, GAP, FASTA and TFASTA programs are part of the GCG Wisconsin Genetics Software Package, Version 10 (available from Accelrys Inc., 9685 Scranton Rd., San Diego, Calif., USA), and can be used for performing sequence alignments. The preferred program is GAP version 10, which used the algorithm of Needleman and Wunsch (1970) supra. Unless otherwise stated the sequence identity similarity values provided herein refer to the value obtained using GAP Version 10 with the following parameters: % identity and % similarity for a nucleotide sequence using GAP Weight of 50 and Length Weight of 3 and the nwsgapdna.cmp scoring matrix; % identity and % similarity for an amino acid sequence using GAP Weight of 8 and Length Weight of 2, and the BLOSUM62 scoring matrix; or any equivalent program. By "equivalent program" is intended any sequence comparison program that, for any two sequences in question, generates an alignment having identical nucleotide or amino acid residue matches and an identical percent sequence identity when compared to the corresponding alignment generated by GAP Version 10.

Alignment of a sequence in a database to a queried sequence produced by BLASTN, FASTA, BLASTP or like algorithm is commonly described as a "hit." Hits to one or more database sequences by a queried sequence produced by BLASTN, FASTA, BLASTP or a similar algorithm, align and identify similar portions of a sequence. A hit to a database sequence generally represents an overlap over a fraction of the sequence length of the queried sequence, i.e., a portion or fragment of the queried sequence. However, the overlap can represent the entire length of the queried sequence. The hits in an alignment to a queried sequence produced by BLASTN, FASTA, or BLASTP algorithms to sequences in a database are commonly arranged in order of the degree of similarity and the length of sequence overlap.

Polynucleotide and polypeptide hits aligned by BLASTN, FASTA, or BLASTP algorithms to a queried sequence produce "Expect" values. The Expect value (E value) indicates the number of hits one can "expect" to see over a certain number of contiguous sequences at random when searching a database of a certain size. The Expect value is used as a significance threshold for determining whether the hit to a database, such as the GenBank or the EMBL database, indicates actual similarity. For example, an E value of 0.1 assigned to a polynucleotide hit is interpreted as meaning that in a database of the size of the GenBank database, one might expect to see 0.1 matches over the aligned portion of the sequence with a similar score randomly. By this criterion, the aligned and matched portions of the polynucleotide sequences then have a probability of 90% of being the same. For sequences having an E value of 0.01 or less over aligned and matched portions, the probability of finding a match randomly in the GenBank database is 1% or less, using the BLASTN or FASTA algorithm.

According to an embodiment of this invention, "variant" polynucleotides and polypeptides of this invention, comprise sequences producing an E value of about 0.01 or less when compared to the polynucleotide or polypeptide sequences of the present invention. That is, a variant polynucleotide or polypeptide is any sequence that has at least a 99% probability of being the same as the polynucleotide or polypeptide of the present invention, measured as having an E value of 0.01 or less using the BLASTN, FASTA, or BLASTP algorithms set at parameters described herein. In other embodiments, a variant polynucleotide is a sequence having the same number of, or fewer nucleic acids than a polynucleotide of the present invention that has at least a 99% probability of being the same as the polynucleotide of the present invention, measured as having an E value of 0.01 or less using the BLASTN or FASTA algorithms set at parameters described herein. Similarly, a variant polypeptide is a sequence having the same number of, or fewer amino acids than a polypeptide of the present invention that has at least a 99% probability of being the same as a polypeptide of the present invention, measured as having an E value of 0.01 or less using the BLASTP algorithm set at the parameters described herein.

As noted above, the percentage identity is determined by aligning sequences using one of the BLASTN, FASTA, or BLASTP algorithms, set at the running parameters described herein, and identifying the number of identical nucleic acids or amino acids over the aligned portions; dividing the number of identical nucleic acids or amino acids by the total number of nucleic acids or amino acids of the polynucleotide or polypeptide sequence of the present invention; and then multiplying by 100 to determine the percent identity. For example, a polynucleotide of the present invention having 220 nucleic acids has a hit to a polynucleotide sequence in the GenBank database having 520 nucleic acids over a stretch of 23 nucleotides in the alignment produced by the BLASTN algorithm using the parameters described herein. The 23 nucleotide hit includes 21 identical nucleotides, one gap and one different nucleotide. The percent identity of the polynucleotide of the present invention to the hit in the GenBank library is thus 21/220 times 100, or 9.5%. The polynucleotide sequence in the GenBank database is thus not a variant of a polynucleotide of the present invention.

Identification and Isolation of Homologous Sequences

Stress-related nucleotide sequences identified based on their sequence identity to the stress-related nucleotide sequences set forth herein or to fragments and variants thereof are encompassed by the present invention. Methods such as PCR or hybridization can be used to identify sequences from a cDNA or genomic library, for example, which are substantially identical to a sequence of this invention. See, for example, Sambrook et al. (1989) *Molecular Cloning: Laboratory Manual* (2d ed., Cold Spring Harbor Laboratory Press, Plainview, N.Y.) and Innis, et al. (1990) *PCR Protocols. A Guide to Methods and Applications* (Academic Press, New York). Methods for construction of such cDNA and genomic libraries are generally known in the art and are also disclosed in the above reference.

In hybridization techniques, the hybridization probes may be genomic DNA fragments, cDNA fragments, RNA fragments, or other oligonucleotides, and may consist of all or part of a known nucleotide sequence disclosed herein. In addition, they may be labeled with a detectable group such as $^{32}$p, or any other detectable marker, such as other radioisotopes, a fluorescent compound, an enzyme, or an enzyme co-factor. Probes for hybridization can be made by labeling synthetic oligonucleotides, based on the known stress-related nucleotide sequences disclosed herein. Degenerate primers designed on the basis of conserved nucleotides or amino acid residues in a known stress-related nucleotide sequence or encoded amino acid sequence can additionally be used. The hybridization probe typically comprises a region of nucleotide sequence that hybridizes under stringent conditions to at least about 10, preferably about 20, more preferably about 50, 75, 100, 125, 150, 175, 200, 250, 300, 350, or 400 consecutive nucleotides of a stress-related nucleotide sequence of the invention or a fragment or variant thereof. To achieve specific hybridization under a variety of conditions, such probes include sequences that are unique among stress-related protein sequences. Preparation of probes for hybridization is generally known in the art and is disclosed in Sambrook et al. (1989) *Molecular Cloning: A Laboratory Manual* (2d ed., Cold Spring Harbor Laboratory Press, Plainview, N.Y.), herein incorporated by reference.

In one embodiment, the entire nucleotide sequence encoding a stress-related protein is used as a probe to identify novel stress-related sequences and messenger RNAs. In another embodiment, the probe is a fragment of a nucleotide sequence disclosed herein. In some embodiments, the nucleotide sequence that hybridizes under stringent conditions to the probe can be at least about 300, 325, 350, 375, 400, 425, 450, 500, 550, 600, 650, 700, 800, 900, 1000, 1500, 2000, 2500, 3000, 3500, or 4000 nucleotides in length.

Substantially identical sequences will hybridize to each other under stringent conditions. By "stringent conditions" is intended conditions under which a probe will hybridize to its target sequence to a detectably greater degree than to other sequences (e.g., at least 2-fold over background). Generally, stringent conditions encompass those conditions for hybridization and washing under which nucleotides having at least about 60%, 65%, 70%, preferably 75% sequence identity typically remain hybridized to each other. Stringent conditions are known in the art and can be found in *Current Protocols in Molecular Biology* (John Wiley & Sons, New York (1989)), 6.3.1-6.3.6. Hybridization typically occurs for less than about 24 hours, usually about 4 to about 12 hours.

Stringent conditions are sequence dependent and will differ in different circumstances. Full-length or partial nucleic acid sequences may be used to obtain homologues and orthologs encompassed by the present invention. By "orthologs" is intended genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

When using probes, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides).

The post-hybridization washes are instrumental in controlling specificity. The two critical factors are ionic strength and temperature of the final wash solution. For the detection of sequences that hybridize to a full-length or approximately full-length target sequence, the temperature under stringent conditions is selected to be about 5° C. lower than the thermal melting point ($T_m$) for the specific sequence at a defined ionic strength and pH. However, stringent conditions would encompass temperatures in the range of 1° C. to 20° C. lower than the $T_m$, depending on the desired degree of stringency as otherwise qualified herein. For DNA-DNA hybrids, the $T_m$ can be determined using the equation of Meinkoth and Wahl (1984) *Anal. Biochem.* 138:267-284: $T_m$=81.5° C.+16.6 (logM)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe.

The ability to detect sequences with varying degrees of homology can be obtained by varying the stringency of the hybridization and/or washing conditions. To target sequences that are 100% identical (homologous probing), stringency conditions must be obtained that do not allow mismatching. By allowing mismatching of nucleotide residues to occur, sequences with a lower degree of similarity can be detected (heterologous probing). For every 1% of mismatching, the $T_m$ is reduced about 1° C.; therefore, hybridization and/or wash conditions can be manipulated to allow hybridization of sequences of a target percentage identity. For example, if sequences with ≧90% sequence identity are preferred, the $T_m$ can be decreased by 10° C. Two nucleotide sequences could be substantially identical, but fail to hybridize to each other under stringent conditions, if the polypeptides they encode are substantially identical. This situation could arise, for example, if the maximum codon degeneracy of the genetic code is used to create a copy of a nucleic acid.

Exemplary low stringency conditions include hybridization with a buffer solution of 30-35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, N.Y.); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed.; Cold Spring Harbor Laboratory Press, Plainview, N.Y.).

In a PCR approach, oligonucleotide primers can be designed for use in PCR reactions to amplify corresponding DNA sequences from cDNA or genomic DNA extracted from any organism of interest. PCR primers are preferably at least about 10 nucleotides in length, and most preferably at least about 20 nucleotides in length. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

Assays

Diagnostic assays to detect expression of the disclosed polypeptides and/or nucleic acid molecules as well as their disclosed activity in a sample are disclosed. An exemplary method for detecting the presence or absence of a disclosed nucleic acid or protein comprising the disclosed polypeptide in a sample involves obtaining a sample from a food/dairy/feed product, starter culture (mother, seed, bulk/set, concentrated, dried, lyophilized, frozen), cultured food/dairy/feed product, dietary supplement, bioprocessing fermentate, or a subject that has ingested a probiotic material, and contacting the sample with a compound or an agent capable of detecting the disclosed polypeptides or nucleic acids (e.g., an mRNA or genomic DNA comprising the disclosed nucleic acid or fragment thereof) such that the presence of the disclosed sequence is detected in the sample. Results obtained with a sample from the food, supplement, culture, product, or subject may be compared to results obtained with a sample from a control culture, product, or subject.

One agent for detecting the mRNA or genomic DNA comprising a disclosed nucleotide sequence is a labeled nucleic acid probe capable of hybridizing to the disclosed nucleotide sequence of the mRNA or genomic DNA. The nucleic acid probe can be, for example, a disclosed nucleic acid molecule, such as the nucleic acid of odd SEQ ID NOS:1-365, or a portion thereof, such as a nucleic acid molecule of at least 15, 30, 50, 100, 250, or 500 nucleotides in length and sufficient to specifically hybridize under stringent conditions to the mRNA or genomic DNA comprising the disclosed nucleic acid sequence. Other suitable probes for use in the diagnostic assays of the invention are described herein.

One agent for detecting a protein comprising a disclosed polypeptide sequence is an antibody capable of binding to the disclosed polypeptide, preferably an antibody with a detectable label. Antibodies can be polyclonal, or more preferably, monoclonal. An intact antibody, or a fragment thereof (e.g., Fab or $F(abN)_2$) can be used. The term "labeled," with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

The term "sample" is intended to include tissues, cells, and biological fluids present in or isolated from a subject, as well as cells from starter cultures or food products carrying such cultures, or derived from the use of such cultures. That is, the detection method of the invention can be used to detect mRNA, protein, or genomic DNA comprising a disclosed sequence in a sample both in vitro and in vivo. In vitro techniques for detection of mRNA comprising a disclosed sequence include Northern hybridizations and in situ hybridizations. In vitro techniques for detection of a protein comprising a disclosed polypeptide include enzyme linked immunosorbent assays (ELISAs), Western blots, immunoprecipitations, and immunofluorescence. In vitro techniques for detection of genomic DNA comprising the disclosed nucleotide sequences include Southern hybridizations. Furthermore, in vivo techniques for detection of a protein comprising a disclosed polypeptide include introducing into a subject a labeled antibody against the disclosed polypeptide. For example, the antibody can be labeled with a radioactive marker whose presence and location in a subject can be detected by standard imaging techniques.

In one embodiment, the sample contains protein molecules from a test subject that has consumed a probiotic material. Alternatively, the sample can contain mRNA or genomic DNA from a starter culture.

The invention also encompasses kits for detecting the presence of disclosed nucleic acids or proteins comprising disclosed polypeptides in a sample. Such kits can be used to determine if a microbe expressing a specific polypeptide of the invention is present in a food product or starter culture, or in a subject that has consumed a probiotic material. For example, the kit can comprise a labeled compound or agent capable of detecting a disclosed polypeptide or mRNA in a sample and means for determining the amount of a the disclosed polypeptide in the sample (e.g., an antibody that recognizes the disclosed polypeptide or an oligonucleotide probe that binds to DNA encoding a disclosed polypeptide, e.g., odd SEQ ID NOS:1-365). Kits can also include instructions detailing the use of such compounds.

For antibody-based kits, the kit can comprise, for example: (1) a first antibody (e.g., attached to a solid support) that binds to a disclosed polypeptide; and, optionally, (2) a second, different antibody that binds to the disclosed polypeptide or the first antibody and is conjugated to a detectable agent. For oligonucleotide-based kits, the kit can comprise, for example: (1) an oligonucleotide, e.g., a detectably labeled oligonucleotide, that hybridizes to a disclosed nucleic acid sequence or (2) a pair of primers useful for amplifying a disclosed nucleic acid molecule.

The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples that can be assayed and compared to the test sample contained. Each component of the kit is usually enclosed within an individual container, and all of the various containers are within a single package along with instructions for use.

In one embodiment, the kit comprises multiple probes in an array format, such as those described, for example, in U.S. Pat. Nos. 5,412,087 and 5,545,531, and International Publication No. WO 95/00530, herein incorporated by reference. Probes for use in the array may be synthesized either directly onto the surface of the array, as disclosed in International Publication No. WO 95/00530, or prior to immobilization onto the array surface (Gait, ed. (1984), *Oligonucleotide Synthesis a Practical Approach* IRL Press Oxford, England). The probes may be immobilized onto the surface using techniques well known to one of skill in the art, such as those described in U.S. Pat. No. 5,412,087. Probes may be a nucleic acid or peptide sequence, preferably purified, or an antibody.

The arrays may be used to screen organisms, samples, or products for differences in their genomic, cDNA, polypeptide, or antibody content, including the presence or absence of specific sequences or proteins, as well as the concentration of those materials. Binding to a capture probe is detected, for example, by signal generated from a label attached to the nucleic acid molecule comprising the disclosed nucleic acid sequence, a polypeptide comprising the disclosed amino acid sequence, or an antibody. The method can include contacting the molecule comprising the disclosed nucleic acid, polypeptide, or antibody with a first array having a plurality of capture probes and a second array having a different plurality of capture probes. The results of each hybridization can be compared to analyze differences in expression between a first and second sample. The first plurality of capture probes can be from a control sample, e.g., a wild type lactic acid bacteria, or control subject, e.g., a food, dietary supplement, starter culture sample or a biological fluid. The second plurality of capture probes can be from an experimental sample, e.g., a mutant type lactic acid bacteria, or subject that has consumed a probiotic material, e.g., a starter culture sample, or a biological fluid.

These assays may be especially useful in microbial selection and quality control procedures where the detection of unwanted materials is essential. The detection of particular nucleotide sequences or polypeptides may also be useful in determining the genetic composition of food, fermentation products, or industrial microbes, or microbes present in the digestive system of animals or humans that have consumed probiotics.

Antisense Nucleotide Sequences

The present invention also encompasses antisense nucleic acid molecules, i.e., molecules that are complementary to a sense nucleic acid encoding a protein, e.g., complementary to the coding strand of a double-stranded cDNA molecule, or complementary to an mRNA sequence. Accordingly, an antisense nucleic acid can hydrogen bond to a sense nucleic acid. The antisense nucleic acid can be complementary to an entire stress-related coding strand, or to only a portion thereof, e.g., all or part of the protein coding region (or open reading frame). An antisense nucleic acid molecule can be antisense to a noncoding region of the coding strand of a nucleotide sequence encoding an stress-related protein. The noncoding regions are the 5' and 3' sequences that flank the coding region and are not translated into amino acids. Antisense nucleotide sequences are useful in disrupting the expression of the target gene. Antisense constructions having 70%, preferably 80%, more preferably 85% sequence identity to the corresponding sequence may be used.

Given the coding-strand sequence encoding a stress-related protein disclosed herein (e.g., odd SEQ ID NOS:1-369), antisense nucleic acids of the invention can be designed according to the rules of Watson and Crick base pairing. The antisense nucleic acid molecule can be complementary to the entire coding region of stress-related mRNA, but more preferably is an oligonucleotide that is antisense to only a portion of the coding or noncoding region of stress-related mRNA. An antisense oligonucleotide can be, for example, about 5, 10, 15, 20, 25, 30, 35, 40, 45, or 50 nucleotides in length, or it can be 100, 200 nucleotides, or greater in length. An antisense nucleic acid of the invention can be constructed using chemical synthesis and enzymatic ligation procedures known in the art.

An antisense nucleic acid molecule of the invention can be an α-anomeric nucleic acid molecule (Gaultier et al. (1987) *Nucleic Acids Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330). The invention also encompasses ribozymes, which are catalytic RNA molecules with ribonuclease activity that are capable of cleaving a single-stranded nucleic acid, such as an mRNA, to which they have a complementary region. The invention also encompasses nucleic acid molecules that form triple helical structures. See generally Helene (1991) *Anticancer Drug Des.* 6(6):569; Helene (1992) *Ann. N.Y. Acad. Sci.* 660:27; and Maher (1992) *Bioassays* 14(12):807.

In some embodiments, the nucleic acid molecules of the invention can be modified at the base moiety, sugar moiety, or phosphate backbone to improve, e.g., the stability, hybridization, or solubility of the molecule. As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid-phase peptide synthesis protocols as described, for example, in Hyrup et al. (1996) supra; Perry-O'Keefe et al. (1996) *Proc. Natl. Acad. Sci. USA* 93:14670.

In another embodiment, PNAs of a stress-related molecule can be modified, e.g., to enhance their stability, specificity, or cellular uptake, by attaching lipophilic or other helper groups to PNA, by the formation of PNA-DNA chimeras, or by the use of liposomes or other techniques of drug delivery known in the art. The synthesis of PNA-DNA chimeras can be performed as described in Hyrup (1996) supra; Finn et al. (1996) *Nucleic Acids Res.* 24(17):3357-63; Mag et al. (1989) *Nucleic Acids Res.* 17:5973; and Peterson et al. (1975) *Bioorganic Med. Chem. Lett.* 5:1119.

Fusion Proteins

The invention also includes stress-related chimeric or fusion proteins. A stress-related "chimeric protein" or "fusion protein" comprises a stress-related polypeptide operably linked to a non-stress-related polypeptide. A "stress-related polypeptide" refers to a polypeptide having an amino acid sequence corresponding to a stress-related protein, whereas a "non-stress-related polypeptide" refers to a polypeptide having an amino acid sequence corresponding to a protein that is not substantially identical to the stress-related protein, and which is derived from the same or a different organism. Within a stress-related fusion protein, the stress-related polypeptide can correspond to all or a portion of a stress-related protein, preferably including at least one biologically active portion of a stress-related protein. Within the fusion protein, the term "operably linked" is intended to indicate that the stress-related polypeptide and the non-stress-related polypeptide are fused in-frame to each other. The non-stress-related polypeptide can be fused to the N-terminus or C-terminus of the stress-related polypeptide.

Expression of the linked coding sequences results in two linked heterologous amino acid sequences that form the fusion protein. The carrier sequence (the non-stress-related polypeptide) can encode a carrier polypeptide that potentiates or increases expression of the fusion protein in the bacterial host. The portion of the fusion protein encoded by the carrier sequence, i.e., the carrier polypeptide, may be a protein fragment, an entire functional moiety, or an entire protein sequence. The carrier region or polypeptide may additionally be designed to be used in purifying the fusion protein, either with antibodies or with affinity purification specific for that carrier polypeptide. Likewise, physical properties of the carrier polypeptide can be exploited to allow selective purification of the fusion protein.

Particular carrier polypeptides of interest include superoxide dismutase (SOD), maltose-binding protein (MBP), glutathione-S-transferase (GST), an N-terminal histidine (His) tag, and the like. This list is not intended to be limiting, as any carrier polypeptide that potentiates expression of the stress-related protein as a fusion protein can be used in the methods of the invention.

In one embodiment, the fusion protein is a GST-stress-related fusion protein in which the stress-related sequences are fused to the C-terminus of the GST sequences. In another embodiment, the fusion protein is a stress-related-immunoglobulin fusion protein in which all or part of a stress-related protein is fused to sequences derived from a member of the immunoglobulin protein family. The stress-related-immunoglobulin fusion proteins of the invention can be used as immunogens to produce anti-stress-related antibodies in a subject, to purify stress-related ligands, and in screening assays to identify molecules that inhibit the interaction of a stress-related protein with a stress-related ligand.

One of skill in the art will recognize that the particular carrier polypeptide is chosen with the purification scheme in mind. For example, His tags, GST, and maltose-binding protein represent carrier polypeptides that have readily available affinity columns to which they can be bound and eluted. Thus, where the carrier polypeptide is an N-terminal His tag such as hexahistidine ($His_6$ tag), the stress-related fusion protein can be purified using a matrix comprising a metal-chelating resin, for example, nickel nitrilotriacetic acid (Ni-NTA), nickel iminodiacetic acid (Ni-IDA), and cobalt-containing resin (Co-resin). See, for example, Steinert et al. (1997) *QIAGEN News* 4:11-15, herein incorporated by reference in its entirety. Where the carrier polypeptide is GST, the stress-related fusion protein can be purified using a matrix comprising glutathione-agarose beads (Sigma or Pharmacia Biotech); where the carrier polypeptide is a maltose-binding protein (MBP), the stress-related fusion protein can be purified using a matrix comprising an agarose resin derivatized with amylose.

Preferably, a chimeric or fusion protein of the invention is produced by standard recombinant DNA techniques. For example, DNA fragments coding for the different polypeptide sequences may be ligated together in-frame, or the fusion gene can be synthesized, such as with automated DNA synthesizers. Alternatively, PCR amplification of gene fragments can be carried out using anchor primers that give rise to complementary overhangs between two consecutive gene fragments, which can subsequently be annealed and re-amplified to generate a chimeric gene sequence (see, e.g., Ausubel et al., eds. (1995) *Current Protocols in Molecular Biology* (Greene Publishing and Wiley-Interscience, New York). Moreover, a stress-related-encoding nucleic acid can be cloned into a commercially available expression vector such that it is linked in-frame to an existing fusion moiety.

The fusion protein expression vector is typically designed for ease of removing the carrier polypeptide to allow the stress-related protein to retain the native biological activity associated with it. Methods for cleavage of fusion proteins are known in the art. See, for example, Ausubel et al., eds. (1998) *Current Protocols in Molecular Biology* (John Wiley & Sons, Inc.). Chemical cleavage of the fusion protein can be accomplished with reagents such as cyanogen bromide, 2-(2-nitrophenylsulfenyl)-3-methyl-3'-bromoindolenine, hydroxylamine, or low pH. Chemical cleavage is often accomplished under denaturing conditions to cleave otherwise insoluble fusion proteins.

Where separation of the stress-related polypeptide from the carrier polypeptide is desired and a cleavage site at the junction between these fused polypeptides is not naturally occurring, the fusion construct can be designed to contain a specific protease cleavage site to facilitate enzymatic cleavage and removal of the carrier polypeptide. In this manner, a linker sequence comprising a coding sequence for a peptide that has a cleavage site specific for an enzyme of interest can be fused in-frame between the coding sequence for the carrier polypeptide (for example, MBP, GST, SOD, or an N-terminal His tag) and the coding sequence for the stress-related polypeptide. Suitable enzymes having specificity for cleavage sites include, but are not limited to, factor Xa, thrombin, enterokinase, remin, collagenase, and tobacco etch virus (TEV) protease. Cleavage sites for these enzymes are well known in the art. Thus, for example, where factor Xa is to be used to cleave the carrier polypeptide from the stress-related polypeptide, the fusion construct can be designed to comprise a linker sequence encoding a factor Xa-sensitive cleavage site, for example, the sequence IEGR (see, for example, Nagai and Thøgersen (1984) *Nature* 309:810-812, Nagai and Thøgersen (1987) *Meth. Enzymol.* 153:461-481, and Pryor and Leiting (1997) *Protein Expr. Purif.* 10(3):309-319, herein incorporated by reference). Where thrombin is to be used to cleave the carrier polypeptide from the stress-related polypeptide, the fusion construct can be designed to comprise a linker sequence encoding a thrombin-sensitive cleavage site, for example the sequence LVPRGS or VIAGR (see, for example, Pryor and Leiting (1997) *Protein Expr. Purif.* 10(3):309-319, and Hong et al. (1997) *Chin. Med. Sci. J.* 12(3):143-147, respectively, herein incorporated by reference). Cleavage sites for TEV protease are known in the art. See, for example, the cleavage sites described in U.S. Pat. No. 5,532,142, herein incorporated by reference in its entirety. See also the discussion in Ausubel et al., eds. (1998) *Current Protocols in Molecular Biology* (John Wiley & Sons, Inc.), Chapter 16.

Antibodies

An isolated polypeptide of the present invention can be used as an immunogen to generate antibodies that specifically bind stress-related proteins, or stimulate production of antibodies in vivo. The full-length stress-related protein can be used as an immunogen or, alternatively, antigenic peptide fragments of stress-related proteins as described herein can be used. The antigenic peptide of an stress-related protein comprises at least 8, preferably 10, 15, 20, or 30 amino acid residues of the amino acid sequence shown in even SEQ ID NOS:2-370 and encompasses an epitope of a stress-related protein such that an antibody raised against the peptide forms a specific immune complex with the stress-related protein. Preferred epitopes encompassed by the antigenic peptide are regions of a stress-related protein that are located on the surface of the protein, e.g., hydrophilic regions.

Recombinant Expression Vectors and Host Cells

The nucleic acid molecules of the present invention may be included in vectors, preferably expression vectors. "Vector" refers to a nucleic acid molecule capable of transporting another nucleic acid to which it has been linked. Expression vectors include one or more regulatory sequences and direct the expression of genes to which they are operably linked. By "operably linked" is intended that the nucleotide sequence of interest is linked to the regulatory sequence(s) such that expression of the nucleotide sequence is allowed (e.g., in an in vitro transcription/translation system or in a host cell when the vector is introduced into the host cell). The term "regulatory sequence" is intended to include controllable transcriptional promoters, operators, enhancers, transcriptional terminators, and other expression control elements such as translational control sequences (e.g., Shine-Dalgarno consensus sequence, initiation and termination codons). These regulatory sequences will differ, for example, depending on the host cell being used.

The vectors can be autonomously replicated in a host cell (episomal vectors), or may be integrated into the genome of a host cell, and replicated along with the host genome (non-episomal mammalian vectors). Integrating vectors typically contain at least one sequence homologous to the bacterial chromosome that allows for recombination to occur between homologous DNA in the vector and the bacterial chromosome. Integrating vectors may also comprise bacteriophage or transposon sequences. Episomal vectors, or plasmids are circular double-stranded DNA loops into which additional DNA segments can be ligated. Plasmids capable of stable maintenance in a host are generally the preferred form of expression vectors when using recombinant DNA techniques.

The expression constructs or vectors encompassed in the present invention comprise a nucleic acid construct of the invention in a form suitable for expression of the nucleic acid in a host cell. Expression in prokaryotic host cells is encompassed in the present invention. It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., stress-related proteins, mutant forms of stress-related proteins, fusion proteins, etc.).

Regulatory sequences include those that direct constitutive expression of a nucleotide sequence as well as those that direct inducible expression of the nucleotide sequence only under certain environmental conditions. A bacterial promoter is any DNA sequence capable of binding bacterial RNA polymerase and initiating the downstream (3') transcription of a coding sequence (e.g., structural gene) into mRNA. A promoter will have a transcription initiation region, which is usually placed proximal to the 5' end of the coding sequence. This transcription initiation region typically includes an RNA polymerase binding site and a transcription initiation site. A bacterial promoter may also have a second domain called an operator, which may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence.

An example of a gene activator protein is the catabolite activator protein (CAP), which helps initiate transcription of the lac operon in *Escherichia coli* (Raibaud et al. (1984) *Annu. Rev. Genet.* 18:173). Regulated expression may therefore be either positive or negative, thereby either enhancing or reducing transcription. Other examples of positive and negative regulatory elements are well known in the art. Various promoters that can be included in the protein expression system include, but are not limited to, a T7/LacO hybrid promoter, a trp promoter, a T7 promoter, a lac promoter, and a bacteriophage lambda promoter. Any suitable promoter can be used to carry out the present invention, including the native promoter or a heterologous promoter. Heterologous promoters may be constitutively active or inducible. A non-limiting example of a heterologous promoter is given in U.S. Pat. No. 6,242,194 to Kullen and Klaenhammer.

Sequences encoding metabolic pathway enzymes provide particularly useful promoter sequences. Examples include promoter sequences derived from sugar metabolizing enzymes, such as galactose, lactose (lac) (Chang et al. (1987) *Nature* 198:1056), and maltose. Additional examples include promoter sequences derived from biosynthetic enzymes such as tryptophan (trp) (Goeddel et al. (1980) *Nucleic Acics Res.* 8:4057; Yelverton et al. (1981) *Nucleic Acids Res.* 9:731; U.S. Pat. No. 4,738,921; EPO Publication Nos. 36,776 and 121, 775). The beta-lactamase (bla) promoter system (Weissmann, (1981) "The Cloning of Interferon and Other Mistakes," in *Interferon* 3 (ed. I. Gresser); bacteriophage lambda PL (Shimatake et al. (1981) *Nature* 292:128); the arabinose-inducible araB promoter (U.S. Pat. No. 5,028,530); and T5 (U.S. Pat. No. 4,689,406) promoter systems also provide useful promoter sequences. See also Balbas (2001) *Mol. Biotech.* 19:251-267, where *E. coli* expression systems are discussed.

In addition, synthetic promoters that do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac (Amann et al. (1983) *Gene* 25:167; de Boer et al. (1983) *Proc. Natl. Acad. Sci.* 80:21) and trc (Brosius et al. (1985) *J. Biol. Chem.* 260:3539-3541) promoters are hybrid trp-lac promoters comprised of both trp promoter and lac operon sequences that are regulated by the lac repressor. The tac promoter has the additional feature of being an inducible regulatory sequence. Thus, for example, expression of a coding sequence operably linked to the tac promoter can be induced in a cell culture by adding isopropyl-1-thio-β-D-galactoside (IPTG). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al (1985) *Proc. Natl. Acad. Sci.* 82:1074). In addition, a hybrid promoter can also be comprised of a bacteriophage promoter and an *E. coli* operator region (EPO Publication No. 267, 851).

The vector may additionally contain a gene encoding the repressor (or inducer) for that promoter. For example, an inducible vector of the present invention may regulate transcription from the Lac operator (LacO) by expressing the gene encoding the LacI repressor protein. Other examples include the use of the lexA gene to regulate expression of pRecA, and the use of trpO to regulate ptrp. Alleles of such genes that increase the extent of repression (e.g., lacIq) or that modify the manner of induction (e.g., lambda C1857, rendering lambda pL thermo-inducible, or lambda CI+, rendering lambda pL chemo-inducible) may be employed.

In addition to a functioning promoter sequence, an efficient ribosome-binding site is also useful for the expression of the fusion construct. In prokaryotes, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of bacterial 16S rRNA (Steitz et al. (1979) "Genetic Signals and Nucleotide Sequences in Messenger RNA," in *Biological Regulation and Development: Gene Expression* (ed. R. F. Goldberger, Plenum Press, NY).

Stress-related proteins can also be secreted from the cell by creating chimeric DNA molecules that encode a protein comprising a signal peptide sequence fragment that provides for secretion of the stress-related polypeptides in bacteria (U.S. Pat. No. 4,336,336). The signal sequence fragment typically encodes a signal peptide comprised of hydrophobic amino acids that direct the secretion of the protein from the cell. The protein is either secreted into the growth media (Gram-positive bacteria) or into the periplasmic space, located between the inner and outer membrane of the cell (Gram-negative bacteria). Preferably there are processing sites, which can be cleaved either in vivo or in vitro, encoded between the signal peptide fragment and the stress-related protein.

DNA encoding suitable signal sequences can be derived from genes for secreted bacterial proteins, such as the *E. coli* outer membrane protein gene (ompA) (Masui et al. (1983) FEBS Lett. 151(1):159-164; Ghrayeb et al. (1984) *EMBO J.* 3:2437-2442) and the *E. coli* alkaline phosphatase signal sequence (phoA) (Oka et al. (1985) *Proc. Natl. Acad. Sci.* 82:7212). Other prokaryotic signals include, for example, the signal sequence from penicillinase, Ipp, or heat stable enterotoxin II leaders.

Bacteria such as *L. acidophilus* generally utilize the start codon ATG, which specifies the amino acid methionine (which is modified to N-formylmethionine in prokaryotic organisms). Bacteria also recognize alternative start codons, such as the codons GTG and TTG, which code for valine and leucine, respectively. When they are used as the initiation codon, however, these codons direct the incorporation of methionine rather than of the amino acid they normally encode. *Lactobacillus acidophilus* NCFM recognizes these alternative start sites and incorporates methionine as the first amino acid.

Typically, transcription termination sequences recognized by bacteria are regulatory regions located 3' to the translation stop codon and thus, together with the promoter, flank the coding sequence. These sequences direct the transcription of an mRNA that can be translated into the polypeptide encoded by the DNA. Transcription termination sequences frequently include DNA sequences (of about 50 nucleotides) that are capable of forming stem loop structures that aid in terminating transcription. Examples include transcription termination sequences derived from genes with strong promoters, such as the trp gene in *E. coli* as well as other biosynthetic genes.

The expression vectors will have a plurality of restriction sites for insertion of the stress-related sequence so that it is under transcriptional regulation of the regulatory regions. Selectable marker genes that ensure maintenance of the vector in the cell can also be included in the expression vector. Preferred selectable markers include those that confer resistance to drugs such as ampicillin, chloramphenicol, erythromycin, kanamycin (neomycin), and tetracycline (Davies et al. (1978) *Annu. Rev. Microbiol.* 32:469). Selectable markers may also allow a cell to grow on minimal medium, or in the presence of toxic metabolite and may include biosynthetic genes, such as those in the histidine, tryptophan, and leucine biosynthetic pathways.

The regulatory regions may be native (homologous), or may be foreign (heterologous) to the host cell and/or the nucleotide sequence of the invention. The regulatory regions may also be natural or synthetic. Where the region is "foreign" or "heterologous" to the host cell, it is intended that the region is not found in the native cell into which the region is introduced. Where the region is "foreign" or "heterologous" to the stress-related nucleotide sequence of the invention, it is intended that the region is not the native or naturally occurring region for the operably linked stress-related nucleotide sequence of the invention. For example, the region may be derived from phage. While it may be preferable to express the sequences using heterologous regulatory regions, native regions may be used. Such constructs would be expected in some cases to alter expression levels of stress-related proteins in the host cell. Thus, the phenotype of the host cell could be altered.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

The invention further provides a recombinant expression vector comprising a DNA molecule of the invention cloned into the expression vector in an antisense orientation. That is, the DNA molecule is operably linked to a regulatory sequence in a manner that allows for expression (by transcription of the DNA molecule) of an RNA molecule that is antisense to stress-related mRNA. Regulatory sequences operably linked to a nucleic acid cloned in the antisense orientation can be chosen to direct the continuous or inducible expression of the antisense RNA molecule. The antisense expression vector can be in the form of a recombinant plasmid or phagemid in which antisense nucleic acids are produced under the control of a high efficiency regulatory region, the activity of which can be determined by the cell type into which the vector is introduced. For a discussion of the regulation of gene expression using antisense genes see Weintraub et al. (1986) *Reviews—Trends in Genetics*, Vol. 1(1).

Alternatively, some of the above-described components can be put together in transformation vectors. Transformation vectors are typically comprised of a selectable market that is either maintained in a replicon or developed into an integrating vector, as described above.

Microbial or Bacterial Host Cells

The production of bacteria containing heterologous genes, the preparation of starter cultures of such bacteria, and methods of fermenting substrates, particularly food substrates such as milk, may be carried out in accordance with known techniques, including but not limited to those described in Mäyrä-Mäkinen and Bigret (1993) *Lactic Acid Bacteria*. Salminen and von Wright eds. Marcel Dekker, Inc. New York. 65-96.; Sandine (1996) *Dairy Starter Cultures* Cogan and Accolas eds. VCH Publishers, New York. 191-206; Gilliland (1985) *Bacterial Starter Cultures for Food*. CRC Press, Boca Raton, Fla.

By "fermenting" is intended the energy-yielding, metabolic breakdown of organic compounds by microorganisms that generally proceeds under anaerobic conditions and with the evolution of gas.

Nucleic acid molecules or amino acid sequences of the invention may be introduced into host cells by methods known in the art. By "introducing" is intended introduction into prokaryotic cells via conventional transformation or transfection techniques, or by phage-mediated infection. As used herein, the terms "transformation," "transduction," "conjugation," and "protoplast fusion" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook et al. (1989) *Molecular Cloning: A Laboratory Manual* (2d ed., Cold Spring Harbor Laboratory Press, Plainview, N.Y.) and other laboratory manuals.

Bacterial cells used to produce the stress-related polypeptides of this invention are cultured in suitable media, as described generally in Sambrook et al. (1989) *Molecular Cloning, A Laboratory Manual* (2d ed., Cold Spring Harbor Laboratory Press, Plainview, N.Y.).

Bacterial strains encompassed by the present invention include those that are biologically pure cultures of a bacterium comprising at least one nucleotide or amino acid sequence of the present invention. These strains may include: a *Lactobacillus acidophilus* bacterial strain with an increased ability to survive stressful conditions compared to a wild-type *Lactobacillus acidophilus*, wherein said increased ability to survive stressful conditions is due to expression or overexpression of a nucleotide sequence encoding an amino acid sequence of the present invention; a *Lactobacillus acidophilus* bacterial strain with an increased ability to survive heat shock compared to a wild-type *Lactobacillus acidophilus*, wherein said increased ability to survive heat shock is due to expression or overexpression of a nucleotide sequence encoding an amino acid sequence of the present invention; a *Lac-*

*tobacillus acidophilus* bacterial strain with an increased ability to survive cold shock compared to a wild-type *Lactobacillus acidophilus*, wherein said increased ability to survive cold shock is due to expression or overexpression of a nucleotide sequence encoding an amino acid sequence of the present invention; a *Lactobacillus acidophilus* bacterial strain with an increased ability to survive acidic conditions compared to a wild-type *Lactobacillus acidophilus*, wherein said increased ability to survive acidic conditions is due to expression or overexpression of a nucleotide sequence encoding an amino acid sequence of the present invention; a *Lactobacillus acidophilus* bacterial strain with an increased ability to survive alkaline conditions compared to a wild-type *Lactobacillus acidophilus*, wherein said increased ability to survive alkaline conditions is due to expression or overexpression of a nucleotide sequence encoding an amino acid sequence of the present invention; a *Lactobacillus acidophilus* bacterial strain with an increased ability to survive osmotic stress compared to a wild-type *Lactobacillus acidophilus*, wherein said increased ability to survive osmotic stress is due to expression or overexpression of a nucleotide sequence encoding an amino acid sequence of the present invention; a *Lactobacillus acidophilus* bacterial strain with an increased ability to survive oxidative stress compared to a wild-type *Lactobacillus acidophilus*, wherein said increased ability to survive oxidative stress is due to expression or overexpression of a nucleotide sequence encoding an amino acid sequence of the present invention; a *Lactobacillus acidophilus* bacterial strain with an increased ability to survive starvation conditions compared to a wild-type *Lactobacillus acidophilus*, wherein said increased ability to survive starvation conditions is due to expression or overexpression of a nucleotide sequence encoding an amino acid sequence of the present invention.

Methods of Use

Methods are provided wherein properties of microbes used in fermentation are modified to provide strains able to survive stressful conditions, such as heat or cold shock, acid or alkaline stress, osmotic or oxidative stress, or starvation. This ability to survive stressful environmental conditions will increase the utility of these microorganisms in fermenting various foods, as well as allowing them to provide longer-lasting probiotic activity after ingestion. In general the methods comprise expressing or overexpressing one or more proteins involved in stress resistance. By "overexpressing" is intended that the protein of interest is produced in an increased amount in the modified bacterium compared to its production in a wild-type bacterium. The polypeptide may be expressed, for example, by introducing the polypeptide itself, or a nucleic acid molecule or a vector comprising a nucleotide sequence encoding the polypeptide, into an organism.

A polypeptide of the invention may be introduced into an organism that does not naturally express the polypeptide, or a polypeptide may be expressed in an organism that already expresses the polypeptide. In this way, the polypeptides of the invention are heterologous polypeptides. By "heterologous" is intended a sequence that originates from a foreign species, or, if from the same species, is substantially modified from its native form in composition and/or genomic locus by deliberate human intervention.

Heat Shock

Heat shock proteins play essential physiological roles as molecular chaperones in protecting cells against damage due to thermal stress by binding to cellular proteins in a manner that maintains their native conformation and minimizes denaturation (Martin et al. (1992) *Science* 258:995-998; Craig et al. (1993) *Microbiol. Rev.* 57:402-414). Microorganisms exposed to a sublethal heat treatment acquire the transient ability to withstand subsequent lethal heat challenges and this phenomenon is called acquired thermotolerance (Lindquist (1986) *Annu. Rev. Biochem.* 55:1151-1191; Hahn and Li (1990) *Stress Proteins in Biology and Medicine*. R. I. Morimoto, A. Tissières and C. Georgopoulos. eds. New York, Cold Spring Harbor Laboratory Press:79-100; Mackey and Derrick (1990) *J. Appl. Bacteriol.* 69:373-383; Boutibonnes et al. (1991) *Int. J. Food Microbiol.* 14:1-9).

Heat shock genes are classified according to the mode of regulation and fall within four general classes. Class I genes are organized in two operons, the groE operon and the dnaK operon. The CIRCE (controlling inverted repeat of chaperone expression) operator sequence serves as a cis-acting regulatory element and a binding site for a repressor protein named HrcA (for heat regulation at CIRCE (Schulz and Schumann (1996) *J. Bacteriol.* 178:1088-1093), the first gene product of the dnaK operon and a negative regulator of class I heat shock genes (Yuan and Wong (1995) *J. Bacteriol.* 177:6462-6468); Schulz and Schumann (1996) supra). Class I heat shock proteins of the present invention include those in SEQ ID NOS: 28, 30, 78, and 80.

Expression of class II genes is dependent on the alternate sigma factor named sigma B; the synthesis and activity of sigma B increases under stressful conditions (Petersohn et al. (2001) *J. Bacteriol.* 183:5617-5631; Price et al. (2001) *Mol. Microbiol.* 41:757-774). Class III genes are defined as those lacking a CIRCE element and that are sigma B independent. Members of this class include clpC, clpE, and clpP. Class III genes are negatively regulated by a repressor protein called CtsR (for class three stress gene repressor (Derre et al. (1999) *Mol. Microbiol.* 31:117-131), the product of the first gene in the c/pC operon (Krüger and Hecker (1998) *J. Bacteriol* 180:6681-6688; Derre et al., *Mol. Microbiol.* 31:117-131); Nair et al. (2000) *Mol. Microbiol.* 35:800-811). Class III heat shock proteins of the invention include that in SEQ ID NOS: 20, 40, and 48.

Class IV stress response genes are expressed independent of HrcA, sigma B, and CtsR and the regulatory mechanisms remain to be identified (Hecker et al. (1996) *Mol. Microbiol.* 19:417-428). Examples of class IV stress response genes areftsH, lonA, and htpG. By "heat shock protein" is intended a protein expressed in a bacterium in response to a higher than optimal temperature for bacterial growth or survival. Class IV heat shock proteins of the present invention include that in SEQ ID NOS:18 and 306.

The gene products of the groE (or groESL) operon are the widespread and highly conserved classical heat shock chaperone proteins, GroES and GroEL. As chaperone proteins, GroES and GroEL function to protect the cells against heat shock by binding to cellular proteins in a manner that maintains their native conformation and minimizes denaturation (Craig et al. (1993) supra). Understanding the manner in which these proteins function is facilitated through the description of the three-dimensional molecular structure of GroES and GroEL. The GroEL protein is tetradecameric, consisting of two stacked rings with seven subunits in each ring forming a barrel-shaped structure. The GroES protein is heptameric, resembling a dome-shaped structure (Hartl (1996) *Nature* 381:571-579). After partially denatured proteins enter the GroEL hydrophobic chamber, GroES forms a dome enclosing the chamber, thereby creating a protected environment wherein proteins can fold into native structures (Houry et al. (1999) *Nature* 402:147-154).

Amino acid alignment data suggest that the bicistronic groE operon is highly conserved, containing only two genes and always in the same order: groES followed by groEL (Segal and Ron (1996) *FEMS Microbiol. Lett.* 138:1-10). A defining characteristic is the presence of a highly conserved CIRCE operator sequence (TTAGCACTC-N-9-GAGT-GCTAA) (SEQ ID NO:367), which precedes the first structural gene in both the groE and dnaK operons (Zuber and Schumann (1994) *J. Bacteriol.* 176:1359-1363; Yuan and Wong (1995) *J. Bacteriol.* 177:6462-6468; Mogk et al. (1997) *EMBO J.* 16:4579-4590) and the dnaJ gene in *L. lactis* (van Asseldonk et al. (1993) *J. Bacteriol.* 175:1637-44). In most bacteria, the CIRCE is transcribed with the corresponding genes and participates in the regulation of expression at both the DNA and mRNA levels (Zuber and Schumann (1994) supra; Yuan and Wong (1995) *J. Bacteriol.* 177:5427-5433).

groES is a member of the Chaperonin 10 Kd subunit family (PFAM Accession NO. PF00166). Proteins of the present invention that are members of the Chaperonin 10 Kd subunit family include that in SEQ ID NO:28. groEL is a member of the TCP-1/cpn60 chaperonin family (PFAM Accession No. PF00118). Proteins of the present invention that are members of the TCP-1/cpn60 chaperonin family include that in SEQ ID NO:30. HrcA is a member of the HrcA protein C terminal domain family (PFAM Accession No. PF01628). Proteins of the present invention that are members of the HrcA protein C terminal domain family include that in SEQ ID NO:84. ftsH is a member of the FtsH Extracellular family (PFAM Accession No. PF06480). Proteins of the present invention that are members of the FtsH Extracellular family include that in SEQ ID NO:306.

The DnaK or HSP70 (70 kDa) family of proteins are among the most well-known heat shock proteins. These proteins are ubiquitous and have been found in all prokaryotic and eukaryotic organisms examined to date. The most common sequence of genes in the dnaK operon is hrcA-grpE-dnaK-dnaJ; this organization has been found for example in *Lactobacillus sakei* and *Streptococcus mutans* (Jayaraman et al. (1997) *Mol. Microbiol.* 25:329-341; Schmidt et al. (1999) *Syst. Appl. Microbiol.* 22:321-328). In *L. lactis*, the operon contains three heat shock genes with the arrangement hrcA-grpE-dnaK followed by a fourth open reading frame (Eaton et al. (1993) *J. Gen. Microbiol.* 139:3253-3264). Hsp70 proteins (PFAM Accession No. PF000112) are made up of two regions: the amino terminus is the ATPase domain and the carboxyl terminus is the substrate binding region. Some HSP70 proteins are only expressed under stress conditions (strictly inducible), while some are present in cells under normal growth conditions and are not heat-inducible (constitutive or cognate). Proteins of the present invention that are members of the Hsp70 protein family include that in SEQ ID NO:80.

DnaJ domains (J-domains) are associated with hsp70 heat-shock system and it is thought that this domain mediates the interaction. The prokaryotic heat shock protein DnaJ interacts with the chaperone hsp70-like DnaK protein (Cyr et al. (1994) *Trends Biochem Sci.* 19:176-81). Structurally, the DnaJ protein consists of an N-terminal conserved domain (called 'J' domain) of about 70 amino acids (PFAM Accession No. PF00226), a glycine-rich region ('G' domain') of about 30 residues, a central domain containing four repeats of a CXXCXGXG motif ('CRR' domain) (SEQ ID NO:368) (PFAM Accession No. PF00684) and a C-terminal region of 120 to 170 residues (PFAM Accession No. PF01556). Proteins of the present invention that are members of the DnaJ domain family include that in SEQ ID NO:78. Proteins of the present invention that are members of the DnaJ C terminal region family include that in SEQ ID NO:78. Proteins of the present invention that are members of the DnaJ central domain family include that in SEQ ID NO:78. In prokaryotes, the grpE protein (PFAM Accession No. PF01025) stimulates, jointly with dnaJ, the ATPase activity of the dnaK chaperone. It seems to accelerate the release of ADP from dnaK thus allowing dnaK to recycle more efficiently. GrpE is a protein of about 22 to 25 kD. This protein has chaperone activity. Methods to measure chaperone activity are well known in the art (see, for example, Craig et al. (1993) *Microbiol Rev.* 57:402-14). GrpE proteins of the present inventions include that in SEQ ID NO:82.

Prokaryotic and eukaryotic cells respond to harsh environmental conditions by synthesizing a group of chaperone proteins and proteases, which together serve to maintain quality control of intracellular proteins. As stated earlier, chaperone proteins are responsible for promoting proper assembly of proteins and preventing misfolding and aggregation (Craig et al. (1993) supra). Proteases, on the other hand, degrade permanently damaged proteins. A large family of proteins named Clp contains members that exhibit both proteolytic and chaperone activities. Constituents of this large family of proteins include ClpA, ClpB, ClpC, ClpD, ClpE, ClpP, ClpX, and ClpY (Schirmer et al. (1996) *Trends Biochem. Sci.* 21:289-96). The proteins comprising the Clp family are classified according to structural features and sequence similarities. ClpA proteins are members of the Clp amino terminal domain family (PFAM Accession No. PF02861). This short domain is found in one or two copies at the amino terminus of ClpA and ClpB proteins from bacteria and eukaryotes. The proteins are thought to be subunits of ATP-dependent proteases that act as chaperones to target the proteases to substrates. Proteins of the present invention that are members of the Clp amino terminal domain family include that in SEQ ID NO:20. clpP is a member of the Clp protease family (PFAM Accession No. PF00574). This group of serine peptidases belongs to the MEROPS peptidase family S14 (ClpP endopeptidase family, clan SK). ClpP is an ATP-dependent protease that cleaves a number of proteins, such as casein and albumin. It exists as a heterodimer of ATP-binding regulatory A and catalytic P subunits, both of which are required for effective levels of protease activity in the presence of ATP (Maurizi et al. (1990) *J. Biol. Chem.* 265:12536-45), although the P subunit alone does possess some catalytic activity. This family of sequences represents the P subunit. Methods to measure endopeptidase Clp activity are well known in the art (see, for example, Maurizi et al., 1990, supra). Proteins of the present invention that are members of the Clp protease family include that in SEQ ID NO:40.

ClpX is a member of the ClpX C4-type zinc finger family (PFAM Accession No. PF06689). The ClpX heat shock protein of *Escherichia coli* is a member of the universally conserved Hsp100 family of proteins, and possesses a putative zinc finger motif of the C4 type. This presumed zinc binding domain is found at the N-terminus of the ClpX protein. ClpX is an ATPase which functions both as a substrate specificity component of the ClpXP protease and as a molecular chaperone. Proteins of the present invention that are members of the ClpX C4-type zinc finger family include that in SEQ ID NO:48.

The Hsp20/alpha crystallin family proteins (PFAM Accession No. PF00011) have an average molecular weight of 20 Kd. These proteins act as chaperones that can protect other proteins against heat-induced denaturation and aggregation. Hsp20 proteins seem to form large heterooligomeric aggregates. Structurally, this family is characterized by the presence of a conserved C-terminal domain of about 100 residues.

Proteins of the present invention that are members of the Hsp20/alpha crystallin family include those in SEQ ID NOS: 14 and 304.

ATPase family associated with various cellular activities (AAA) proteins (PFAM Accession No. PF00004) often perform chaperone-like functions that assist in the assembly, operation, or disassembly of protein complexes. These ATPases share a conserved region of about 220 amino acids that contains an ATP-binding site. The proteins that belong to this family either contain one or two AAA domains. It is proposed that, in general, the AAA domains in these proteins act as ATP-dependent protein clamps (Confalonieri and Duguet (1995) *Bioessays* 17(7):639-650). In addition to the ATP-binding 'A' and 'B' motifs, which are located in the N-terminal half of this domain, there is a highly conserved region located in the central part of the domain. Proteins of the present invention that are members of the ATPase family associated with various cellular activities family include those in SEQ ID NOS:18, 20, 48, 158, and 306.

The Hsp33 protein (PFAM Accession No. PF01430) is a molecular chaperone, distinguished from all other known chaperones by its mode of functional regulation. Its activity is redox regulated. Hsp33 is a cytoplasmically localized protein with highly reactive cysteines that respond quickly to changes in the redox environment. Oxidizing conditions like $H_2O_2$ cause disulfide bonds to form in Hsp33, a process that leads to the activation of its chaperone function (Jakob et al. (1999) *Cell* 96:341-352). Methods are known in the art for determining chaperone activity (see, for example, Jakob et al., 1999, supra). Proteins of the present invention that are members of the Hsp33 protein family include that in SEQ ID NO:22.

In one embodiment of the invention, expression of one or more heat shock proteins of the present invention in a microorganism, such as a bacterium, allows for increased survival of that organism at high temperatures. A method for increasing the ability of an organism to survive heat shock conditions, comprising introducing into said organism a vector comprising at least one nucleotide sequence Methods are known in the art for expressing heat shock proteins (see, for example, Thomas and Baneyx (1996) *J. Biol. Chem.* 271: 11141-11147; Lee and Olins (1992) *J. Biol. Chem.* 267:2849-2852). Alternatively, one or more heat shock proteins from one microorganism are isolated and expressed in another organism (see, for example, Mizunoe et al. (1999) *Microbiol. Immunol.* 43:513-520; Ferreyra et al. (1993) *J. Bacteriol.* 175:1514-1523; Dionisi et al. (1998) *Protein Expr. Purif.* 14:275-82.). Heat shock proteins of the present invention include those as set forth in SEQ ID NOS:4, 14, 18, 20, 22, 28, 30, 40, 46, 48, 58, 78, 80, 82, 84, 150, 152, 158, 304, 306, 310 and 340.

Cold Shock

Whereas high temperatures diminish protein stability, low temperatures present a cell with a wide array of challenges, such as decreased rate of enzymatic reactions, lower affinity for substrate uptake (Nedwell and Rutter (1994) *Appl. Environ. Microbiol.* 60:1984-1992), decreased fluidity of the cellular membrane (Wada et al. (1990) *Nature* 347:200-203), impaired activity of RNA polymerase (Grau et al. (1994) *Mol. Microbiol.* 11:933-941), and increased intracellular solute concentration which can invoke osmotic injury on proteins (Franks (1995) *Adv. Protein Chem.* 46:105-139). Death associated with freezing and thawing is primarily attributed to membrane damage and DNA denaturation (Alur and Grecz (1975) *Biochem. Biophys. Res. Comm.* 62:308-312; Calcott and MacLeod (1975) *Can. J. Microbiol.* 21:1960-1968; El-Kest and Marth (1992) *Journal of Food Protection* 55:639-648). Bacterial adaptation to low temperatures is an active process resulting in increased fatty acid unsaturation (Murata and Wada (1995) *Biochem, J.* 308:1-8) and polypeptide synthesis (Jones et al. (1987) *J. Bacteriol.* 169:2092-2095).

The study of the cold shock response in LAB is particularly important because these microorganisms are routinely exposed to a variety of stresses, including low temperature conditions, during the production of fermented food products (Rallu et al. (1996) *Antonie van Leeuwenhoek* 70:243-251). For example, fermentations normally begin with the addition of a frozen "starter" culture to "raw" food material. Therefore, understanding the cold shock response in these organisms may contribute to the development of starter cultures with a greater capacity for freeze tolerance.

Similar to the heat shock response, bacteria respond to low temperatures by expressing a number of cold shock proteins (Jones et al. (1987) supra) regulated at both transcriptional (La Teana et al. (1991) *Proc. Natl. Acad. Sci. USA* 88:10907-10911; Jones et al. (1992) *J. Bacteriol.* 174:5798-5802) and translational (Brandi et al. (1996) *Mol. Microbiol.* 19:231-240; Goldenberg et al. (1996) *Mol. Microbiol.* 19:241-248; Jones et al. (1996) *Proc. Natl. Acad. Sci. USA* 93:76-80; Panoff and Lucas (1996) *Microbiology* 142:1-2) levels. However, in contrast to heat shock proteins, which include chaperones and proteases required for protein folding and degradation, respectively, cold shock proteins perform a variety of different functions in bacterial cells. One of the major outcomes of low temperature exposures is the formation of stable DNA and RNA secondary structures that interfere with efficient DNA replication and mRNA transcription and translation. Cold shock proteins comprise a family of small (7 kDa) transiently expressed proteins that function as RNA chaperones to facilitate translation of mRNA by blocking the formation of secondary structures (Jiang et al. (1997) *J. Biol. Chem.* 272:196-202).

Low-temperature stress proteins are generally labeled as cold shock proteins (CSPs), whereas cold acclimation proteins (CAPs) or cold-induced proteins (CIPs) are labeled as such according to the size of the protein and the method by which the organisms were transferred to low temperatures. By "cold stress protein" is intended cold shock proteins, cold acclimation proteins and cold-induced proteins. Cold stress proteins are expressed in a bacterium in response to a lower than optimal temperature for bacterial growth or survival. The CSPs are immediately and transiently induced upon an abrupt shift to a low temperature (Jones et al. (1987) supra; Lottering and Streips (1995) *Curr. Microbiol.* 30:193-199), whereas CAPs are synthesized during continuous growth at low temperatures (Roberts and Inniss (1992) *Curr. Microbiol.* 25:275-278; Whyte and Inniss (1992) *Can. J. Microbiol.* 38:1281-1285; Berger et al. (1996) *J. Bacteriol.* 178:2999-3007).

Much of the current understanding of the cold shock response has come from investigations on *E. coli* and *B. subtilis*. All CSPs share high sequence similarity (over 40%) to eukaryotic Y-box proteins (Wolffe et al. (1992) *New Biol.* 4:290-298) and both CspA of *E. coli* and CspB of *B. subtilis* recognize the highly conserved Y-box sequence ATTGG (La Teana et al. (1991) supra; Jones et al. (1992) supra; Graumann and Marahiel (1994) *FEBS Lett.* 338:157-160), which is present in regulatory regions of major histocompatibility complex II genes (Sommerville and Ladomery (1996) *FASEB J.* 10:435-443). The Y-box proteins serve regulatory functions at the transcriptional and translational level. Accordingly, the CSP-homologous domain was shown to confer sequence-specific binding to single-stranded DNA and RNA (Sommerville and Ladomery (1996) supra). Both NMR and X-ray crystallography showed that the three dimensional structures of CspB (*B. subtilis*) and CspA (*E. coli*), the major cold shock proteins (Goldstein et al. (1990) *Proc. Natl. Acad. Sci. USA* 87:283-287; Graumann and Marahiel (1994) supra), displayed very similar five-stranded β-barrel structures with outward-facing residues for ssDNA binding (Schindelin et al. (1993) *Nature* 364:164-167; Schnuchel et al. (1993) *Nature* 364:169-171; Newkirk et al. (1994) *Proc. Natl. Acad. Sci. USA* 91:5114-5118; Schindelin et al. (1994) *Proc. Natl. Acad. Sci. USA* 91:5119-5123). Physiological investigations have confirmed CspA and CspB as ssDNA-binding proteins (Graumann and Marahiel (1994) supra; Newkirk et al. (1994) supra). Furthermore, CspA and CspB exhibit mRNA binding capacity because both have RNA-binding motifs, RNP-1 (ribonucleoprotein) and RNP-2 (Schindelin et al. (1993) supra; Jones and Inouye (1994) *Mol. Microbiol.* 11:811-818; Jiang et al. (1997) supra).

Perhaps the single greatest contribution to the understanding of the physiological and regulatory roles of CSPs in LAB was made by Wouters et al. (2000) *Appl. Environ. Microbiol.* 66:3756-3763, who attempted to overproduce these CSPs in *L. lactis* using the nisin controlled expression (NICE) system (Kuipers et al. (1998) *J. Biotechnol.* 64:15-21). Using the NICE system, CspB, CspD, and CspE were overproduced to high levels, whereas the concentrations of CspA and CspC were limited due to low protein and mRNA stability, respectively. The reduced stability of CspA is attributed to the presence of an Arg residue at position 58 rather than a Pro residue, which are known to reduce the entropy of unfolded proteins (Schindler et al. (1999) *J. Biochem.* 274:3407-3413). Replacing the Arg residue at position 58 for a Pro residue increased the concentration of CspA* 20-fold upon induction with nisin. Overproduction of CspA* resulted in the induction of CspE and several CIPs. Likewise, overproducing CspC resulted in the induction of CspB and the putative CspF and CspG proteins, in addition to several CIPs. This suggests that CspA* and CspC may be transcriptional activators acting on Y-box motifs (La Teana et al. (1991) supra; Jones et al. (1992) supra; Brandi et al. (1994) *Biochimie* 76:1090-1098) observed in the upstream regions of the Lactococcal csp genes (Wouters et al. (1998) *Microbiology* 144:2885-2893).

Overproduction of CspA, CspB, CspD, or CspE did not affect the level of any of the other CSPs; however, overproduction of CspB and CspD increased the synthesis of several CIPs, suggesting a regulatory role for these proteins. With respect to adaptation to freeze-survival, overproduction of CspB and CspE resulted in approximately a ten- and five-fold increased survival, respectively, compared to that of non-induced cells after four repetitive freeze-thaw cycles. In a previous report, overexpression of CspD in *L. lactis* cells enhanced survival after freezing approximately two to ten-fold compared to the control cells (Wouters et al. (1999) *Microbiology* 145:3185-3194). Overproduction of CspA, CspC, or CspA* provided no additional freeze-protective effects compared to control cells (Wouters et al. (2000) supra). These results indicate that CspB, CspE, and CspD are directly involved in the protection against freezing (Wouters et al. (1999) supra; Wouters et al. (2000) supra).

'Cold-shock' DNA-binding domain proteins (PFAM Accession No. PF00313) have a conserved domain of about 70 amino acids known as the 'cold-shock domain' (CSD). Proteins of the present invention that have a 'Cold-shock' DNA-binding domain include that in SEQ ID NO:302. The bacterial low temperature requirement A protein family (LtrA) (PFAM Accession No. PF06772) consists of several bacteria specific low temperature requirement A (LtrA) protein sequences which have been found to be essential for growth at low temperatures in *Listeria monocytogenes* (Zheng and Kathariou (1995) *Appl. Environ. Microbiol.* 61:4310-4314). Proteins of the present invention that are members of the bacterial low temperature requirement A protein family include that in SEQ ID NO:144.

In one embodiment of the invention, at least one cold stress protein is expressed in a microorganism, such as a lactic acid bacterium, providing increased survival for the microorganism in cold or freezing temperatures. Methods for expressing or overexpressing cold stress proteins and for measuring survival rates of microorganisms are known in the art (see, for example, Wouters et al. (2000) supra; Wouters et al. (1999) supra; Graumann and Marahiel (1997) *Mol. Gen. Genet.* 253:745-752.). Cold stress proteins of the present invention include those as set forth in SEQ ID NOS:144 and 302.

Acid Tolerance

The understanding of acid tolerance and adaptation in LAB is expected to contribute to enhancement of probiotic survival through the gastrointestinal tract. Furthermore, this understanding is important with regard to starter culture performance during fermentation since cell growth is always accompanied by lactic acid accumulation. Lactic acid poses a significant threat to the cell because in a low pH environment, organic acids remain protonated and uncharged and can thereby pass easily into the cell through the cell membrane. At a similar extracellular pH, a strong inorganic acid, such as HCl, is likely to be in a disassociated state and will not passively diffuse through the cell membrane (Kashket (1987) *FEMS Microbiol. Rev.* 46:233-244). Accordingly, reducing the intracellular pH of *L. lactis* and *S. bovis* was more effective when the extracellular pH was adjusted with lactic acid than with HCl acid (Poolman et al. (1987) *J. Bacteriol.* 169:5373-5378; Cook and Russel (1994) *Curr. Microbiol.* 28:165-168).

Bacteria are equipped with a number of mechanisms that confer acid tolerance, including proton translocation, the arginine deiminase (ADI) pathway, amino acid decarboxylation-antiporter reactions, and the citrate transport system. The activation of these mechanisms is the result of an altered pattern of gene expression when bacteria are confronted with a change in the extracellular pH (Olson (1993) *Mol. Microbiol.* 8:5-14).

Mechanisms underlying acid tolerance utilized by Gram-positive bacteria also include proteins involved in repair or degradation of damaged cell components, incremental expression of regulators that promote minor or global responses, and alterations in the composition of the cell envelope (Cotter and Hill (2003) *Microbiol. Mol. Biol. Rev.* 67:429-453; Girgis, H. S., J. Smith, J. B. Luchansky, and T. R. Klaenhammer. 2003. Stress adaptations of lactic acid bacteria, p. 159-211. In A. E. Yousef and V. K. Juneja (ed.), Microbial stress adaptation and food safety. CRC Press, Boca Raton, Fla.). Exposure to low pH causes an increase in the abundance of ATPase-specific mRNA, indicating regulation at the level of transcription.

Acid-adapted cells showed enhanced survival capacity against lethal acid challenge relative to unadapted cells (Goodson and Rowbury (1989) *Lett. Appl. Microbiol.* 8:77-79; Foster and Hall (1990) *J. Bacteriol.* 172:771-778; Davis et al. (1996) *Microbiology* 142:2975-2982; O'Driscoll et al. (1996) *Appl. Environ. Microbiol.* 62:1693-1698). This inducible adaptation to acid is termed the acid tolerance response (ATR) (Foster and Hall (1990) supra) and has been observed in several LAB.

The multisubunit $F_1F_0$ ATPase, and the amino acid decarboxylation-antiporter systems are the main proton pumps utilized by these microorganisms. The $F_1F_0$ ATPase functions to maintain a favorable intracellular pH and protect cells during exposure to acidic environments by translocating protons to the environment at the expense of ATP. The activity and number of proton-translocating ATPases increases in several LAB as the extracellular pH is adjusted from neutral to pH 5.0 (Kobayashi et al. (1984) *J. Bacteriol.* 158:1157-1160; Belli and Marquis (1991) *Appl. Environ. Microbiol.* 57:1134-1138; Nannen and Hutkins (1991) *J. Dairy Sci.* 74:747-751). Proton-translocating ATPase is an important mechanism in maintaining cytoplasmic pH in *Lb. acidophilus* (Kullen and Klaenhammer (1999) *Mol. Microbiol.* 33:1152-1161). The $F_1F_0$-ATPase system of *L. acidophilus* has been well characterized (Kullen and Klaenhammer (1999) *Mol. Microbiol.* 33:1152-1161).

Bacteria metabolize arginine by the arginine deiminase (ADI) pathway (Cunnin et al. (1986) *Microbiol. Rev.* 50:314-352). This pathway consists of three enzymes: arginine deiminase, ornithine carbamoyltransferase, and carbamate kinase. A fourth component is a membrane-bound antiport protein that catalyzes the exchange between arginine and ornithine. These enzymes catalyze the conversion of arginine to ornithine, ammonia, and carbon dioxide and generate 1 mol of ATP per mol of arginine consumed. By generating ammonia, the ADI pathway is a mechanism for survival in acidic environments (Marquis et al. (1987) *Appl. Environ. Microbiol.* 53:198-200). The development of acid tolerance depends on the rise in pH associated with ammonia production (Marquis et al. (1987) supra).

The enzymes in the ADI pathway are inherently acid tolerant and are activated in response to low pH (pH 2 to 3) in several species of *Streptococcus*. As such, these enzymes allow bacteria to recover from acid stress severe enough to prevent the cell membrane from functioning normally (Casiano-Colon and Marquis (1988) *Appl. Environ. Microbiol.* 54:1318-1324). In most LAB, the ADI pathway is repressed by glucose and induced by arginine (Simon et al. (1982) *J. Bacteriol.* 150:1085-1090; Hiraoka et al. (1986) *Biochem. Int.* 12:881-887.; Manca de Nadra et al. (1986) *Curr. Microbiol.* 13:155-158; Poolman et al. (1987) *J. Bacteriol.* 169:5597-5604). The ADI pathway imparts LAB with enhanced tolerance to acid, primarily through the continuous production of acid-neutralizing ammonia from arginine.

Another strategy bacteria employ to maintain a favorable intracellular pH depends on amino acid decarboxylation-antiporter reactions. These reactions involve transporting an amino acid into the cell where it is decarboxylated. A proton is consumed in the reaction, and the product is exported from the cell via an antiporter. The result of this reaction is a decrease in intracellular acidity (Molenaar et al. (1993) *J. Bacteriol.* 175:2864-2870). Several inducible amino acid decarboxylases, including lysine, ornithine, and arginine decarboxylases, which contribute to raising the pH have been described for *Salmonella enterica* serovar *Typhimurium*. Inducible arginine decarboxylase and glutamate decarboxylases (GAD) have been described for both *Escherichia coli* and *Shigella flexneri* (Bearson et al. (1997) *FEMS Microbiol. Lett.* 147:173-180). Among Gram-positive bacteria, a GAD system has been described for *Listeria monocytogenes* (Cotter et al. (2001) *Mol. Microbiol.* 40:465-475) and *Lactococcus lactis* (Nomura et al. (1999) *Microbiology* 145:1375-1380).

SEQ ID NO:62 is a member of the Orn/Lys/Arg decarboxylase, C-terminal domain family (PFAM Accession No. PF03711), as well as a member of the Orn/Lys/Arg decarboxylase, major domain family (PFAM Accession No. PF01276). Pyridoxal-dependent decarboxylases are bacterial proteins acting on ornithine, lysine, arginine and related substrates. One of the regions of sequence similarity contains a conserved lysine residue, which is the site of attachment of the pyridoxal-phosphate group. Methods to measure catalytic activity are well known in the art (see, for example, Takatsuka et al. (2000) *J. Bacteriol.* 182:6732-41).

A gadC-encoded glutamate-γ-aminobutyrate antiporter and a gadB-encoded glutamate decarboxylase have been identified in *L. lactis* (Sanders et al. (1998) *Mol. Microbiol.* 27:299-310). The two genes are located in a bicistronic gadCB operon and show increased expression during growth and acidification of unbuffered media supplemented with glutamate (Sanders et al. (1998) supra). According to the model proposed by Waterman and Small (Waterman and Small (1996) *Mol. Microbiol.* 21:925-940) for *Shigella flexneri*, the putative membrane protein, GadC, is involved in the antiport of glutamate, while glutamate decarboxylase, GadB, converts the internalized glutamate to γ-aminobutyrate with the simultaneous consumption of a proton and production of one molecule of $CO_2$. The net result is the removal of a proton from the cytosol, which increases the intracellular pH. Support for the amino acid decarboxylation-antiport model is displayed in a histidine decarboxylase mutant of *Lactobacillus* 30a that was unable to alkalinize its environment in the presence of histidine (Recsie and Snell (1972) *J. Bacteriol.* 112:624-626). SEQ ID NO:2 is a GadC Glutamate:gamma aminobutyrate antiporter.

Another function for GadCB may be production of a proton motive force and generation of energy in the presence of glutamate, as shown for a strain of *Lactobacillus* (Higuchi et al. (1997) *J. Bacteriol.* 179:3362-3364). A similar mechanism was described for a different *Lactobacillus* strain, where the action of amino acid antiport and decarboxylation are combined for pH regulation and energy production. The aspartate-alanine antiporter generated ATP in *Lactobacillus* strain M3 (Abe et al. (1996) *J. Biol. Chem.* 271:3079-3084), and histidine decarboxylation coupled with electrogenic histidine-histamine antiport contributed to energy production and intracellular acid reduction in *Lb. buchneri* (Molenaar et al. (1993) *J. Bacteriol.* 175:2864-2870).

Citrate is present in milk at low concentrations and is co-metabolized with glucose by many strains of LAB (Cocaign-Bousquet et al. (1996) *Antonie van Leeuwenhoek* 70:253-267). The citrate fermentation pathway is induced by citrate in *Lc. mesenteroides* (Marty-Teysset et al. (1996) *J. Bacteriol.* 178:6209-6215). Alternatively, citrate utilization in *L. lactis* subsp. *lactis* biovar diacetylactis is dependent on the rate of uptake, catalyzed by the product of the citP gene (David et al. (1990) *J. Bacteriol.* 172:5789-5794), and expression and activity of citP is influenced by extracellular pH (Garcia-Quintans et al. (1998) *Appl. Environ. Microbiol.* 64:850-857; Magni et al. (1996) *FEMS Microbiol. Lett.* 142:265-269). Accordingly, cell growth accompanied by the natural acidification of the medium results in increased synthesis of CitP, higher citrate transport activity, and greater flux through the citrate fermentation pathway. Upon entering the cell, citrate is cleaved by citrate lyase, which yields acetate and oxaloacetate. Decarboxylation of oxaloacetate yields carbon dioxide and pyruvate, consumes a proton, and results in alkalinization of the cytoplasm (Ramos et al. (1994) *J. Bacteriol.* 176:4899-4905; Lolkema et al. (1995) *J. Bioenerg. Biomembr.* 27:467-473; Marty-Teysset et al. (1996) supra). Pyruvate is converted to the end product lactate, which leaves the cell through the CitP transporter in exchange for citrate. Together, the consumption of a proton during oxaloacetate decarboxylation and the excretion of lactate, in exchange for citrate, provide citrate-fermenting LAB with a resistance mechanism against acid toxicity. This acid resistance mechanism was demonstrated by the undiminished growth of *L. lactis* in a medium at pH 4.5 containing both glucose and citrate, whereas growth was poor in the absence of either glucose, citrate, or CitP (Garcia-Quintans et al. (1998) supra); glucose is required to produce lactate that drives the exchange for citrate via the CitP transporter. The CitP transporter is purported to be among the proteins that are synthesized de novo during inducible adaptation to acid (e.g. acid tolerance response), shedding some light on the poorly understood mechanisms involved in acid resistance in bacteria.

Members of the amino acid permease family (PFAM Accession No. PF00324) are integral membrane proteins involved in the transport of amino acids into the cell. These proteins seem to contain up to 12 transmembrane segments. The best conserved region in this family is located in the second transmembrane segment. Methods to measure transport activity are well known in the art (see, for example, Steffes et al. (1992) *J. Bacteriol.* 174:3242-9). Proteins of the present invention that are members of the amino acid permease family include those as set forth in SEQ ID NOS:2, 126, 238, and 338.

SEQ ID NO:6 is a member of the Peptidase M48 family (PFAM Accession No. PF01435). This group of metallopeptidases belongs to the MEROPS peptidase family M48 (Ste24 endopeptidase family, clan M-); members of both subfamily are represented. The members of this set of proteins are homologs of protease htpX (EC:3.4.24) or CAAX prenyl protease 1, which proteolytically removes the C-terminal three residues of farnesylated proteins. They are integral membrane proteins associated with the endoplasmic reticulum and Golgi complex, binding one zinc ion per subunit. In *Saccharomyces cerevisiae*, Ste24p is required for the first NH2-terminal proteolytic processing event within the a-factor precursor, which takes place after COOH-terminal CAAX modification is complete. The Ste24p contains multiple predicted membrane spans, a zinc metalloprotease motif (HEXXH), and a COOH-terminal ER retrieval signal (KKXX). The HEXXH protease motif is critical for Ste24p activity, since Ste24p fails to function when conserved residues within this motif are mutated. The Ste24p homologues occur in a diverse group of organisms, including *Escherichia coli, Schizosaccharomyces pombe, Haemophilus influenzae*, and *Homo sapiens*, which indicates that the gene is highly conserved throughout evolution. Ste24p and the proteins related to it define a subfamily of proteins that are likely to function as intracellular, membrane-associated zinc metalloproteases (Fujimura-Kamada et al. (1997) *J. Cell Biol.* 136:271-85). Methods for measuring metalloendopeptidase activity are well known in the art (see, for example, Yan et al. (1987) *Eur. J. Biochem.* 163:259-65).

SEQ ID NO:10 is a cardiolipin synthase and is a member of the Phospholipase D Active site motif-containing family (PFAM Accession No. PF00614). Phosphatidylcholine-hydrolyzing phospholipase D (PLD) isoforms are activated by ADP-ribosylation factors (ARFs). PLD produces phosphatidic acid from phosphatidylcholine, which may be essential for the formation of certain types of transport vesicles or may be constitutive vesicular transport to signal transduction pathways. PC-hydrolyzing PLD is a homologue of cardiolipin synthase, phosphatidylserine synthase, bacterial PLDs and viral proteins. Each of these appears to possess a domain duplication that is apparent by the presence of two motifs containing well-conserved histidine, lysine, and/or asparagine residues that may contribute to the active site, aspartic acid. Methods for measuring catalytic activity are well known in the art (see, for example, Wang et al. (1994) *J. Biol. Chem.* 269:20312-7).

SEQ ID NO:24 is a member of the impB/mucB/samB family (PFAM Accession No. PF00817). These proteins are involved in UV protection. In bacteria, UV and many chemicals appear to cause mutagenesis by a process of translesion synthesis that requires DNA polymerase III and the SOS-regulated proteins UmuD, UmuC and RecA. This machinery allows the replication to continue through DNA lesion, and therefore avoids lethal interruption of DNA replication after DNA damage. Methods to measure DNA repair are well known in the art (see, for example, Smith and Walker (1998) *Genetics* 148:1599-610).

SEQ ID NO:32 is a member of the Bacterial regulatory proteins, lacI family (PFAM Accession No. PF00356). Numerous bacterial transcription regulatory proteins bind DNA via a helix-turn-helix (HTH) motif. Within this family, the HTH motif is situated towards the N-terminus. Methods to measure transcription factor activity are well known in the art (see, for example, Reidl et al. (1989) *J. Bacteriol.* 171:4888-99).

SEQ ID NOS:34, 38, 72, 142, 154, 308, and 344 are members of the Pyridine nucleotide-disulfide oxidoreductase family (PFAM Accession No. PF00070). This family includes both class I and class II oxidoreductases and also NADH oxidases and peroxidases. This domain is actually a small NADH binding domain within a larger FAD binding domain. Methods to measure disulfide oxidoreductase activity are well known in the art (see, for example, Veine et al. (1998) *Protein Sci.* 7:369-75).

SEQ ID NO:44 is a member of the universal stress protein family (PFAM Accession No. PF00582). The universal stress protein UspA is a small cytoplasmic bacterial protein whose expression is enhanced when the cell is exposed to stress agents. UspA enhances the rate of cell survival during prolonged exposure to such conditions, and may provide a general “stress endurance” activity.

SEQ ID NO:56 is a member of the Proteasome A-type and B-type family (PFAM Accession No. PF00227). ATP-dependent protease complexes are present in all three kingdoms of life, where they rid the cell of misfolded or damaged proteins and control the level of certain regulatory proteins. They include the proteasome in Eukaryotes, Archaea, and Actinomycetales and the HslVU (ClpQY, clpXP) complex in other eubacteria. In prokaryotes, the ATP-dependant proteasome is coded for by the heat-shock locus VU (HslVU). It consists of HslV, the protease (MEROPS peptidase subfamily TIB), and HslU, the ATPase and chaperone, which belong to the AAA/Clp/Hsp 100 family. Methods for measuring endopeptidase activity are well known in the art (see, for example, Rohrwild et al. (1996) *Proc. Natl. Acad. Sci. U.S.A.* 93:5808-13).

In one embodiment of the invention, at least one acid tolerance protein is expressed or overexpressed in a microorganism, thereby allowing the microorganism to survive in acidic environments. By “acid tolerance protein” is intended a protein expressed in a bacterium in response to a lower than optimal pH for bacterial growth or survival. Methods for measuring acid tolerance are known in the art (see, for example, De Angelis et al. (2001) *Microbiology* 147:1863-1873. Acid tolerance proteins of the present invention include SEQ ID NOS:2, 4, 6, 10, 14, 18, 20, 22, 24, 28, 30, 32, 34, 38, 40, 42, 44, 46, 48, 52, 56, 60, 62, 72, 78, 80, 82, 84, 126, 142, 150, 152, 154, 158, 238, 306, 308, 338, and 344. Acid tolerance proteins of the present invention also include those sequences listed in Tables 4 and 5. These tables list the most highly expressed proteins of *Lactobacillus acidophilus* NCFM when grown at pH 4.5 and pH 5.5 (see Example 2).

Alkaline Stress Response

Exposure to sublethal alkaline conditions results in increased resistance to lethal alkalinization (pH 10.0 to 10.5) in *E. coli* (Goodson and Rowbury (1990) *Lett. Appl. Microbiol.* 11: 123-125). As early as 1934, Sherman and Stark, identified *E. faecalis* by its ability to grow at pH 9.6. A neutral cytoplasmic pH is not required to withstand high alkaline pH in *Enterococcus hirae* (Mugikura et al. (1990) *J. Biochem.* 108:86-91); however, the alkaline treatment amplifies the $Na^+$-ATPase (Kakinuma and Igarashi (1990) *FEBS Lett.* 261: 135-138), suggesting modification in gene expression. This hypothesis was confirmed when whole-cell proteins extracted from *E. faecalis*, viewed on two-dimensional gel electrophoresis, showed amplification of 37 polypeptides after a 30-minute alkaline treatment at pH 10.5 (Flahaut et al. (1997) *Lett. Appl. Microbiol.* 26:259-264). Furthermore, cells adapted to pH 10.5 were tolerant to pH 11.9.

In one embodiment of the invention, at least one alkaline tolerance protein is expressed or overexpressed in a microorganism, allowing increased survival in alkaline environments. By "alkaline tolerance protein" is intended a protein expressed in a bacterium in response to a lower than optimal pH for bacterial growth or survival. Methods to assay alkaline tolerance in bacteria are well known in the art (see, for example, Taormina and Beuchat (2001) *Appl. Env. Microbiol.* 67:2555-2563). Alkaline tolerance proteins of the present invention include the protein as set forth in SEQ ID NO:138.

Osmotic Stress

Organisms, both eukaryotic and prokaryotic, respond to osmotic stress in essentially the same way, by accumulating non-toxic low molecular weight compounds. These compounds, called compatible solutes, which include sugars, polyols, amino acids and amine derivatives, do not inhibit vital cellular functions even when present in very high concentrations. Compatible solutes have at least three functions: i) allow the cell to retain positive turgor pressure which contributes to osmotic balance with the extracellular environment; ii) enhance enzyme stability at low $a_w$; and iii) maintain the integrity of the cellular membrane during desiccation (Kets and de Bont (1994) *FEMS Microbiol. Lett.* 116:251-256.).

Glycine betaine was identified some years ago as the intracellular osmolyte that protected *L. acidophilus* from osmotic stress (Hutkins et al. (1987) *Appl. Environ. Microbiol.* 53:2275-2281). Glycine betaine is a constituent of the yeast extract present in MRS medium and upon the addition of NaCl (1 M), glycine betaine is transported into the cells by a specific transport system. The rate of glycine betaine transport is proportional to the osmolality of the medium. Energy in the form of a fermentable sugar was necessary for glycine betaine transport. There are two systems for the uptake of glycine betaine. One system transports only glycine betaine, whereas the other system transports glycine betaine, carnitine and choline.

In a defined medium, the growth of *Lb. plantarum* strain P743 in 0.6 M NaCl decreased seven-fold; however, the addition of 2 mM glycine betaine permitted growth almost to the level of the control treatment that was lacking salt. In addition, glycine betaine addition allowed growth at higher NaCl levels (Kets and de Bont (1994) supra). Cells grown under osmotic stress (NaCl) in the presence of glycine betaine survived drying at higher levels than did unconditioned cells.

The intracellular accumulation of quaternary ammonium compatible solutes in *Lb. plantarum* ATCC 14917 is mediated via a single transport system, QacT (quaternary ammonium compound transporter), which has a high affinity for glycine betaine or carnitine and a low affinity for proline (Glaasker et al. (1998) *J. Bacteriol.* 180:5540-5546). Transport uptake rates were inhibited by internal glycine betaine or proline; however, with an increase in osmolarity, the inhibition by the internal osmolyte was relieved with the rapid activation of the QacT system. The QacT uptake system is turgor-regulated; however, when cell turgor is restored, solute uptake is diminished. Inhibition of QacT by an internal compatible solute such as glycine betaine also acts to control excessive accumulation of compatible solute. On hypo-osmotic shock, compatible solutes are released from the cell in order to maintain cell turgor. Efflux occurs via two mechanisms: i) a rapid almost instantaneous release of solute mediated by a channel system followed by ii) a slow release of solute via an efflux carrier system (Glaasker et al. (1996) *J. Biol. Chem.* 271:10060-10065; Glaasker et al. (1996) *J. Bacteriol.* 178:575-582; Glaasker et al. (1998) *J. Bacteriol.* 180: 5540-5546; Glaasker et al. (1998) *J. Bacteriol.* 178:575-582).

Osmoregulation in *Lb. plantarum* ATCC 14917 has been envisioned by Poolman and Glassker (1998) *Mol. Microbiol.* 29:397-407 as follows: under osmostasis, there is a basal level of glycine betaine or other compatible solute which is maintained by the combined action of efflux via the specific efflux carrier system and uptake by QacT; the efflux channel system does not play a role in osmostasis. During hyper-osmotic shock, QacT is activated and glycine betaine enters the cell; both efflux systems are inhibited. Under hypo-osmotic shock, QacT is inhibited but both efflux systems are activated (Poolman and Glaasker (1998) supra). Therefore, maintenance of cell turgor is tightly regulated in *Lb. plantarum.*

SEQ ID NO:4 is a member of the PDZ domain family (PFAM Accession No. PF00595). PDZ domains are found in diverse signaling proteins in bacteria, yeasts, plants, insects and vertebrates. PDZ domains can occur in one or multiple copies and are nearly always found in cytoplasmic proteins. They bind either the carboxyl-terminal sequences of proteins or internal peptide sequences (Ponting et al. (1997) *Bioessays* 19:469-79). In most cases, interaction between a PDZ domain and its target is constitutive, with a binding affinity of 1 to 10 μM. However, agonist-dependent activation of cell surface receptors is sometimes required to promote interaction with a PDZ protein. PDZ domain proteins are frequently associated with the plasma membrane, a compartment where high concentrations of phosphatidylinositol 4,5-bisphosphate (PIP2) are found. PDZ domains consist of 80 to 90 amino acids comprising six β-strands (betaA to betaF) and two α-helices, A and B, compactly arranged in a globular structure. Peptide binding of the ligand takes place in an elongated surface groove as an antiparallel β-strand interacts with the betaB strand and the B helix. The structure of PDZ domains allows binding to a free carboxylate group at the end of a peptide through a carboxylate-binding loop between the betaA and betaB strands.

In one embodiment of the invention, at least one osmotic stress-related protein is expressed or overexpressed in an organism, allowing increased survival in undesirable osmotic conditions. By "osmotic stress-related protein" is intended a protein expressed in a bacterium in response to a non-optimal osmotic environment for bacterial growth or survival. Methods to measure bacterial survival rates in such conditions are well known in the art (see, for example, Kets and de Bont (1994) supra). Osmotic stress-related proteins of the present invention include those as set forth in SEQ ID NOS:4, 60, 126, 316, and 336.

Oxidative Stress

LAB are facultative anaerobes that metabolize carbohydrates via fermentation. Although they lack a functional electron transport chain, LAB perform several oxidation and reduction reactions during the catabolism of carbohydrates. Some of these reactions use molecular oxygen ($O_2$) as a substrate. The presence of oxygen can generate partially reduced toxic intermediates of $O_2$ such as superoxide anion ($\beta 2^-$), hydrogen peroxide ($H_2O_2$), and hydroxyl radical ($^{\bullet}OH$) (McCord et al. (1971) *Proc. Natl. Acad. Sci. USA* 68:1024-1027; Repine et al. (1981) *J. Biol. Chem.* 256:7094-7096). These intermediates are also formed through a variety of intracellular reactions. For example, $H_2O_2$ is formed through the activity of $H_2O_2$-forming flavoprotein oxidases (Whittenbury (1964) *J. Gen. Microbiol.* 35:13-26), such as NADH oxidase and pyruvate oxidase, and during the dismutation of $O_2^-$ by superoxide dismutase (SOD) (Britton et al. (1978) *J. Bacteriol.* 134:229-236). The simultaneous presence of hydrogen peroxide and superoxide anions can lead further to the formation of hydroxyl radicals [$O_2^- + H_2O_2 \rightarrow OH^- + {}^{\bullet}OH + O_2$] (Gregory and Fridovich (1974) *J. Bacteriol.* 117:166-169), which are particularly harmful in *Lactobacillus* since members of this genus lack SOD and are unable to eliminate superoxide anions (Gregory and Fridovich (1974) supra). Together, these reactive oxygen intermediates can cause severe oxidative damage such as strand breaks in DNA (Storz et al. (1987) *Proc. Natl. Acad. Sci. USA* 84:8917-8921; Teebor et al. (1988) *Int. J. Radiat. Biol.* 54:131-150; Piard and Desmazeaud (1991) *Le Lait* 71:525-541), oxidation of membrane lipids (Meads (1976) *Free Radicals in Biology*. W. A. Pryor. ed. New York, Academic Press:51-68), and inactivation of enzymes (Wolff et al. (1986) *Trends Biochem.* 11:27-31). To counter oxidative stress, LAB maintain an inducible defense system to detoxify the oxidants and repair the damage. The dismutation of reactive oxygen intermediates in LAB depends on the activities of NADH oxidase, NADH peroxidase, glutathione, and thioredoxin. With the exception of certain strains of *Lactobacillus sake* (Knauf et al. (1992) *Appl. Environ. Microbiol.* 58:832-839), *Lb. plantarum* (Kono and Fridovich (1983) *J. Biol. Chem.* 258:6015-6019), *Lactobacillus pentosus*, and *Pediococcus acidilactici* (Wolf et al. (1991) *Int. J. Food Microbiol.* 12:133-140), LAB are notable for their inability to produce catalase. LAB exhibiting this rare property are summarized by Hammes et al. (1990) *FEMS Microbiol. Rev.* 87:165-174.

Enhanced tolerance to $H_2O_2$ after a sublethal treatment of $H_2O_2$ has been described in Gram-negative bacteria such as *E. coli* and *S. typhimurium* (Demple and Halbrook (1983) *Nature* 304:466-468; Christman et al. (1985) *Cell* 41:753-762) and in Gram-positive bacteria such as *B. subtilis* (Murphy et al. (1987) *J. Bacteriol.* 169:5766-5770; Dowds (1994) *FEMS Microbiol. Lett.* 124:255-264). *E. faecalis* (Flahaut et al. (1998) *Lett. Appl. Microbiol.* 26:259-264) and *L. lactis* (Condon (1987) *FEMS Microbiol. Rev.* 46:269-280) exhibited an inducible oxidative stress response when exposed to sublethal concentrations of $H_2O_2$. The induced response provided enhanced protection against normally lethal levels of $H_2O_2$.

NADH Oxidase/NADH Peroxidase

Some LAB have NADH oxidases (Anders et al. (1970) *Appl. Microbiol.* 19:608-612; Lucey and Condon (1986) *J. Gen. Microbiol.* 132:1789-1796; Condon (1987) supra; Smart and Thomas (1987) *Appl. Environ. Microbiol.* 53:533-541.) that use molecular oxygen to oxidize NADH. The NADH oxidases are thought to detoxify molecular oxygen by catalyzing its reduction via NADH into either $H_2O$ or $H_2O_2$ (Higuchi (1992) *Oral Microbiol. Immunol.* 7:309-314). The $H_2O$-forming NADH oxidase has been proposed to function as a defense against oxidative stress, based on the production of large amounts of $H_2O$-forming NADH oxidase to reduce $O_2$ relative to smaller amounts of $H_2O_2$-forming NADH oxidase in *S. mutans* (Higuchi (1992) supra).

*Streptococcus mutans* has two distinct NADH oxidases, Nox-1 catalyzing the formation of $H_2O_2$ and Nox-2 producing $H_2O$ (Higuchi et al. (1993) *J. Gen. Microbiol.* 139:2343-2351). The two enzymes reveal different characteristics (Higuchi et al. (1993) supra): Nox-1 catalyzes the two-electron reduction of $O_2$ by NADH, whereas Nox-2 catalyzes the four-electron reduction of $O_2$ by NADH. Nox appears to provide protection against oxidative stress in two ways. First, the reduction of oxygen to water evades the formation of any toxic intermediates (Higuchi (1992) supra). Second, the development of competence through NADH oxidase activity provides an extracellular source of DNA to aid in repairing damage to the chromosome caused by oxygen radicals (Auzat et al. (1999) *Mol. Microbiol.* 34:1018-1028).

The production of a reactive oxygen species such as $H_2O_2$ by Nox-1 to counter oxidative damage is illogical. However, located directly upstream of the nox-1 gene on the *S. mutans* chromosome is an ahpC gene encoding an enzyme homologous with the non-flavoprotein component (AhpC) of *S. typhimurium* alkyl hydroperoxide reductase. This enzyme system functions to defend cells against oxidative damage (Jacobson et al. (1989) *J. Biol. Chem.* 264:1488-1496). Because nox-1 is linked to ahpC, AhpC can reduce the $H_2O_2$ produced by nox-1 to $H_2O$. The combined reactions of Nox-1 and AhpC are as follows: $2NADH + 2H^+ + O_2 \rightarrow 2\ NAD^+ + 2H_2O$ (Higuchi et al. (1999) *J. Bacteriol.* 181:5940-5947). Therefore, Nox-1 functions in combination with AhpC to form an alkyl hydroperoxide reductase system in *S. mutans* (Poole et al. (1997) *Flavins and flavoproteins* 1996. K. J. Stevenson, V. Massey and J. C. H. Williams. eds. Calgary, Alberta, Canada, University of Calgary Press:769-772). In *S. typhimurium*, alkyl hydroperoxide reductase is composed of AhpC and AhpF and defends against oxidative damage by reducing organic hydroperoxides and hydrogen peroxide (Jacobson et al. (1989) supra; Poole and Ellis (1996) *Biochemistry* 35:56-64). *S. typhimurium* and *E. coli* ahpCF-defective mutants showed increased sensitivity to cumene hydroperoxide (Storz et al. (1989) *J. Bacteriol.* 171:2049-2055). Transforming an ahpCF-defective *E. coli* mutant with both nox-1 and ahpC genes from *S. mutans* not only restored, but it actually enhanced resistance to cumene hydroperoxide relative to the *E. coli* parent strain (Higuchi et al. (1999) supra).

SEQ ID NO:290 is a member of the NADH:flavin oxidoreductase/NADH oxidase family (PFAM Accession No. PF00724). Methods for measuring oxidoreductase activity are well known in the art (see, for example, Singh et al. (2004) *J. Biol. Chem.* 279:43098-106).

Another flavoprotein oxidase that protects cells against the threat of $H_2O_2$-induced oxidative stress is NADH peroxidase. In converting $H_2O_2$ to water, NADH peroxidase plays an analogous role to Nox-2 and alkyl hydroperoxidase reductase. The gene encoding NADH peroxidase (npr) has been identified and characterized in *E. faecalis* (Ross and Claiborne (1991) *J. Mol. Biol.* 221:857-871), and like nox-2 and ahpC in *S. mutans* (Higuchi et al. (1999) supra), the npr gene is induced in *E. faecalis* upon exposure to oxygen (Rothschild et al. (1991) *Genetics and Molecular Biology of Streptococci, Lactococci, and Enterococci*. G. M. Dunny, P. P. Cleary and L. L. McKay. eds. Washington, D.C., American Society for Microbiology: 45-48). The upstream region of the npr gene shares homology with the OxyR-binding site of the ahpC gene from *S. typhimurium* (Ross and Claiborne (1991) supra). In *S. typhimurium* and *E. coli*, OxyR is a transcriptional activator and global regulator protein (Christman et al. (1985) supra) that mediates the $H_2O_2$-induced oxidative stress response (Tartaglia et al. (1989) *J. Mol. Biol.* 210:709-719; Storz et al. (1990) *Science* 248:189-94; Storz and Altuvia (1994) *Methods Enzymol.* 234:217-223). More specifically, it controls the expression of a set of antioxidants that detoxify reactive oxygen species and repair the damage caused by oxidative stress (Storz and Imlay (1999) *Curr. Opin. Microbiol.* 2:188-194). Upon a shift in the intracellular redox potential, OxyR binds to a specific sequence located just upstream from the promoter region of the corresponding structural genes (Tartaglia et al. (1989) supra). No homologue of OxyR has been found in LAB; however, OxyR purified from *E. coli* binds to and retards DNA fragments containing npr from *E. faecalis* in gel shift assays, suggesting that npr from *E. faecalis* may be regulated by OxyR (Ross and Claiborne (1997) *FEMS Microbiol. Lett.* 151:177-183).

SEQ ID NOS:34, 38, 72, 142, 154, 308, and 344 are members of the Pyridine nucleotide-disulfide oxidoreductase family (PFAM Accession No. PF00070). This family includes both class I and class II oxidoreductases and also NADH oxidases and peroxidases. This domain is actually a small NADH binding domain within a larger FAD binding domain. Methods to measure disulfide oxidoreductase activity are well known in the art (see, for example, Veine et al. (1998) *Protein Sci.* 7:369-75).

NADH Oxidase/NADH Peroxidase proteins of the present invention include those in SEQ ID NOS:34, 38, 72, 142, 154, 206, 246, 290, 292, 308, 342, and 344.

Glutaredoxin and Thioredoxin

Glutaredoxin and thioredoxin are structurally similar, particularly in the region of the active site (Holmgren and Aslund (1995) *Methods Enzymol.* 252:283-292). The active site of these proteins contains two conserved cysteine residues that form a disulfide when oxidized and a dithiol when reduced (Holmgren (1989) *J. Biol. Chem.* 264:13963-13966). Aside from participating in the reduction of essential enzymes, such as ribonucleotide reductase and a number of metabolic enzymes that form a disulfide as part of the catalytic cycle (Holmgren (1989) supra; Rietsch and Beckwith (1998) *Annu. Rev. Genet.* 32:163-184.), glutaredoxin and thioredoxin function to repair oxidatively damaged proteins (Holmgren (1989) supra; Wells et al. (1993) *Adv. Enzymol.* 66:149-199) and maintain a favorable intracellular redox potential by reducing disulfide bonds (Prinz et al. (1997) *J. Biol. Chem.* 272:15661-15667). To return to the functional state, these proteins must be reduced. Thioredoxin reductase and glutathione reductase are flavoenzymes that use NADPH to reduce thioredoxin and glutathione, respectively, and glutathione then reduces glutaredoxin.

Thioredoxin (PFAM Accession No. PF00085) is a ubiquitous protein isolated and characterized from bacteria, yeast, plants, and animals (Holmgren (1985) *Annu. Rev. Biochem.* 54:237-271). The active site of thioredoxin contains two cysteine residues that form a disulfide when the protein is oxidized or a dithiol when reduced. The disulfide bond of oxidized thioredoxin is reduced by NADPH and an enzyme called thioredoxin reductase (Moore et al. (1964) *J. Biol. Chem.* 239:3445-3453). Methods to measure electron transporter activity are well known in the art (see, for example, Lyles and Gilbert (1994) *J. Biol. Chem.* 269:30946-52). Proteins of the present invention that are members of the thioredoxin family include those in SEQ ID NOS:286 and 288.

Glutathione can provide intracellular reducing capacity and accumulation of glutathione in LAB is dependent on the type of medium (Fernandez and Steele (1993) *J. Dairy Sci.* 76:1233-1242) and transport from the environment (Wiederholt and Steele (1994) *J. Dairy Sci.* 77:1183-1188). In some LAB, such as *L. lactis*, glutathione is present in high concentrations (Fahey et al. (1978) *J. Bacteriol.* 133:1126-1129).

Superoxide Dismutase

Superoxide dismutase (SOD) converts superoxide anions ($O_2$) to molecular oxygen ($O_2$) and hydrogen peroxide ($H_2O_2$) (Bannister et al. (1987) *CRC Rev. Biochem.* 22:111-180). Therefore, this enzyme provides defense against oxygen toxicity and a direct correlation has been found between the concentration of SOD in an organism and its level of tolerance to oxygen (Tally et al. (1977) *Infect. Immun.* 16:20-25). Many LAB eliminate oxygen radicals by superoxide dismutase or a high internal $Mn^{2+}$ concentration (Archibald and Fridovich (1981) *J. Bacteriol.* 146:928-936). LAB that lack SOD use $Mn^{2+}$ to scavenge $O_2^-$, as demonstrated in *Lb. plantarum* and many other *lactobacilli* and *streptococci* strains (Archibald and Fridovich (1981) *J. Bacteriol.* 146:928-936). However, organisms possessing SOD were more oxygen tolerant than organisms dependent upon $Mn^{2+}$ for scavenging $O_2^-$ (Archibald and Fridovich (1981) *J. Bacteriol.* 146:928-936).

recA, fpg, and DNA Damage

The recA gene is ubiquitous among bacteria and responds to DNA damage caused by oxidative stress. In the absence of oxidative stress, RecA initiates recombination between homologous strands of DNA (Cassuto et al. (1980) *Proc. Natl. Acad. Sci. USA* 77:3962-3966). When DNA is damaged, the RecA protein is activated upon binding to single-stranded DNA (Roberts and Devoret (1982) *Lambda II*. R. W. Hendrix, J. W. Roberts, F. W. Stahl and R. A. Weisberg. eds. Cold Spring Harbor, N.Y., Cold Spring Harbor Laboratory Press: 123-144). The activated RecA protein induces expression of several DNA-repair genes in the SOS pathway (Walker (1984) *Microbiol. Rev.* 48:60-93). Therefore, RecA serves a regulatory function in response to oxidatively damaged DNA (Walker (1984) supra; Miller and Kokjohn (1990) *Annu Rev Microbiol* 44:365-394).

In addition to DNA damaging agents, expression of recA was also induced in aerated cultures. A *L. lactis* recA mutant was highly sensitive to aeration, as evidenced by a lower growth rate and reduced viability during stationary phase (Duwat et al. (1995) *Genetics of Streptococci, Enterococci, and Lactococci*. J. J. Ferretti, M. S. Gilmore, T. R. Klaenhammer and F. Brown. eds. Karger, Basel, *Dev. Biol. Stand.* 85: 455-467). As *L. lactis* produces hydrogen peroxide and acid in the presence of iron, hydroxyl radicals are formed. Hydroxyl radicals can be produced by the Fenton reaction: $H_2O_2+Fe^{2+}+H^+\rightarrow {}^{\bullet}OH+H_2O+Fe^{3+}$ (*Fenton* (1894) *J. Chem. Soc:* 65:899-910; Lesko et al. (1980) *Biochemistry* 19:3023-3028). It is believed that hydroxyl radical formation is the leading cause of the poor growth of the recA aerated culture because the addition of catalase to the recA aerated growth medium restored growth, such that the doubling time was the same as in the non-aerated culture (Duwat et al. (1995) *Genetics of Streptococci, Enterococci, and Lactococci*. J. J. Ferretti, M. S. Gilmore, T. R. Klaenhammer and F. Brown. eds. Karger, Basel, *Dev. Biol. Stand.* 85: 455-467). Furthermore, the removal of $Fe^{2+}$, by adding the $Fe^{2-}$-specific chelating agent ferrozine (Artiss et al. (1981) *Clin. Biochem.* 14:311-315), also restored the doubling time of the aerated recA cultures to that of non-aerated cultures (Duwat et al. (1995) *Mol. Microbiol.* 17:1121-1131). The *L. lactis* recA mutant had three-fold higher levels of HflB (which down regulates expression of heat shock proteins in *E. coli* (Herman et al. (1995) *Proc. Natl. Acad. Sci. USA* 92:3516-3520)), and decreased levels of heat shock proteins, and it showed poor growth at 37° C. relative to the wild type strain. These observations suggested that recA may also be involved in the regulation of the heat shock response (Duwat et al. (1995) *Mol. Microbiol.* 17:1121-1131).

SEQ ID NO:296 is a member of the recA bacterial DNA recombination protein family (PFAM Accession No. PF00154). The sequence of recA is well conserved. The core ATP-binding site domain is well conserved, with 14 invariant residues. It contains the nucleotide binding loop between β-strand 1 and α-helix C. The consensus sequence of amino acids (G/A)XXXXGK(T/S) (SEQ ID NO:376) for the Walker A box (also referred to as the P-loop) is found in a number of nucleoside triphosphate (NTP)-binding proteins. Another nucleotide binding motif, the Walker B box is found at β-strand 4 in the RecA structure. The Walker B box is characterized by four hydrophobic amino acids followed by an acidic residue (usually aspartate). Nucleotide specificity and additional ATP binding interactions are contributed by the amino acid residues at β-strand 2 and the loop C-terminal to that strand, all of which are greater than 90% conserved among bacterial RecA proteins. Methods to measure DNA-dependent ATPase activity are well known in the art (see, for example, Selbitschka et al. (1991) *Mol. Gen. Genet.* 229:86-95).

Upstream of the *L. lactis* recA gene is a region of DNA with strong homology with the gene encoding the DNA repair enzyme formamidopyrimidine DNA glycosylase (fpg), found in *E. coli* and *Bacillus firmus* (Boiteux et al. (1987) *EMBO J.* 6:3177-3183; Boiteux and Huisman (1989) *Mol. Gen. Genet.* 215:300-315). In *E. coli*, the fpg gene product is involved with DNA repair associated with oxidative stress (Czeczot et al. (1991) *J. Bacteriol.* 173:3419-3424) and is unlinked to recA (Boiteux and Huisman (1989) supra). *L. lactis* fpg is co-transcribed with recA, and Duwat et al. (Duwat et al. (1992) *Appl. Environ. Microbiol.* 58:2674-2678) suggest the proximity of recA and fpg in *L. lactis* may indicate overlapping regulation linking recombination and DNA repair. The *L. lactis* Fpg protein is structurally and functionally similar to the Fpg protein in *E. coli*. In both organisms, Fpg protects DNA against the mutagenic action of 8-oxoguanine (Michaels and Miller (1992) *J. Bacteriol.* 174:6321-6325; Grollman and Moriya (1993) *Trends Genets* 9:246-249; Duwat et al. (1995) *Microbiology* 141:411-417).

In one embodiment of the invention, at least one oxidative stress-related protein is expressed or overexpressed in a microorganism, providing increased survival of that organism under non-optimal oxidative stress conditions. By "oxidative stress-related protein" is intended a protein expressed in a bacterium in response to a non-optimal oxidative environment for bacterial growth or survival. Methods for measuring survival under harmful oxidative conditions are well known in the art (see, for example, Murphy et al. (1987) *J. Bacteriol.* 169:5766-5770). Oxidative stress-related proteins of the present invention include those set forth in SEQ ID NOS:34, 38, 70, 72, 142, 154, 158, 154, 156, 206, 246, 286, 288, 290, 292, 296, 308, 342 and 344.

Starvation

Bacterial cells enter the stationary phase upon depletion of essential nutrients from the growth medium. During nutrient starvation, there is a gradual decrease in the growth rate, which eventually approaches zero. To survive, bacteria must make an orderly transition into the stationary phase in such a manner that DNA replication is not terminated prematurely, that viability is maintained, and that cells can return to exponential growth when starvation is relieved. In non-sporulating bacteria during starvation, there occur a number of changes in cellular protein composition that are characterized by degradation of some previously synthesized proteins, increased synthesis of some proteins common to exponential phase growth and de novo protein synthesis. Starvation also induces resistance to a number of environmental stresses without prior exposure to those stresses (Kolter et al. (1993) *Ann. Rev. Microbiol.* 47:855-874).

The proteins synthesized during starvation are probably involved in maintenance of cell viability and in resistance to numerous stresses. When the synthesis of starvation proteins is completed, metabolic activity is greatly diminished; however, the cells are not dormant like bacterial spores. The starved cells do maintain some level of metabolic activity (Kolter et al. (1993) supra), because when fresh nutrients are added, the cells respond rapidly. Synthesis of RNA starts almost immediately, but protein synthesis lags for a short period. Increases in cell mass, in rate of DNA synthesis, and in cell number follow the reinstating of RNA and protein synthesis, but there is a progressive loss of the enhanced resistance to environmental stresses that was induced during starvation (Kolter et al. (1993) supra).

SEQ ID NO:74 is a member of the PhoH-like protein family (PFAM Accession No. PF02562. PhoH is a cytoplasmic protein and predicted ATPase that is induced by phosphate starvation. Methods to measure ATP-binding activity are well known in the art (see, for example, Kim et al. (1993) *J. Bacteriol.* 175:1316-24).

In one embodiment of the invention, at least one starvation-induced protein is expressed or overexpressed in a bacterial cell, providing an increased ability to survive starvation conditions. By "starvation-induced protein" is intended a protein expressed in a bacterium in response to a non-optimal nutrient environment for bacterial growth or survival. Methods to measure survival rates under starvation conditions are well known in the art (see, for example, Watson et al. (1998) *J. Bacteriol.* 180:150-1758). Starvation-induced proteins of the present invention include those in SEQ ID NOS:54, 74 and 314.

Overlapping Regulatory Networks and Cross-Protection

Aside from synthesizing a specific set of proteins in response to an individual stress, many microorganisms induce a stress regulon consisting of an overlapping set of general stress response proteins that may confer general protection to a variety of deleterious conditions. The universal induction of many of the same stress proteins following exposure to a variety of different mild stresses has been demonstrated in *E. coli* (Jenkins et al. (1991) *J. Bacteriol.* 173:1992-1996), *B. subtilis* (Hecker and Völker (1990) *FEMS Microbiol. E col.* 74:197-214; Völker et al. (1992) *J. Gen. Microbiol.* 138:2125-2135.), *E. faecalis* (Flahaut et al. (1996) *FEMS Microbiol. Lett.* 138:49-54), and *L. lactis* (Hartke et al. (1994) *Appl. Environ. Microbiol.* 60:3474-3478; Hartke et al. (1995) *Arch. Microbiol.* 163:329-336; Hartke et al. (1997) *Curr. Microbiol.* 34:23-26). This production of overlapping stress response proteins due to a variety of different environmental stresses may be responsible for the phenomenon known as cross-protection, which is observed when cells survive an otherwise lethal exposure to one form of stress after adapting to a different sublethal condition.

Cross-protection has been demonstrated in *E. coli* (Jenkins et al. (1990) *J. Bacteriol.* 172:2779-2781), *S. typhimurium* (Leyer and Johnson (1993) *Appl. Environ. Microbiol.*

59:1842-1847), and *B. subtilis* (Völker et al. (1992) supra). Among the LAB, cross-protection has been described in *L. lactis, E. faecalis*, and *Lactobacillus collinoides*. For example, carbohydrate-starved cultures of *L. lactis* are significantly more resistant to heat, ethanol, acid, and osmotic stress than nourished, exponential-phase cells (Hartke et al. (1994) supra). Furthermore, heat-induced cross-protection against freezing and lyophilization was achieved in *L. lactis.*

As stated above, the overlap in the number of heat shock proteins expressed during exposure to heat, bile, and ethanol, suggesting similar mechanisms of response, may be the basis for cross-protection. Preconditioning *E. faecalis* with heat or bile failed to induce acid tolerance, and acid-adapted cells displayed slight resistance to heat and no resistance to bile challenge (Flahaut et al. (1996) *FEMS Microbiol. Lett.* 138: 49-54).

SEQ ID NO:8 is a member of the Integral membrane protein TerC family (PFAM Accession No. PF03741). This family contains a number of integral membrane proteins, including the TerC protein. TerC has been implicated in resistance to tellurium and may be involved in efflux of tellurium ions. The tellurite-resistant *Escherichia coli* strain KL53 was found during testing of the group of clinical isolates for antibiotics and heavy metal ion resistance (Burian et al. (1998) *Folia Microbiol* (Praha). 43:589-99). The determinant of the tellurite resistance of the strain was located on a large conjugative plasmid. Analyses showed the genes terB, terC, terD and terE are essential for conservation of the resistance. The members of the family contain a number of conserved aspartates that could be involved in binding to metal ions.

SEQ ID NO:36 is a member of the HPr Serine kinase N terminus family (PFAM Accession No. PF02603), as well as a member of the HPr Serine kinase C terminus family (PFAM Accession No. PF07475). The N terminus family represents the N-terminal region of Hpr Serine/threonine kinase PtsK. The C terminus family represents the C terminal kinase domain of Hpr Serine/threonine kinase PtsK. This kinase is the sensor in a multicomponent phosphorelay system in control of carbon catabolic repression in bacteria (Marquez et al. (2002) *Proc. Natl. Acad. Sci. U.S.A.* 99:3458-63). This kinase is unusual in that it recognizes the tertiary structure of its target and is a member of a novel family unrelated to any previously described protein phosphorylating enzymes. X-ray analysis of the full-length crystalline enzyme from *Staphylococcus xylosus* at a resolution of 1.95 Å shows the enzyme to consist of two clearly separated domains that are assembled in a hexameric structure resembling a three-bladed propeller. The blades are formed by two N-terminal domains each and the compact central hub assembles the C-terminal kinase domains (Reizer et al. (1998) *Mol. Microbiol.* 27:1157-69). Methods for measuring ATP binding are well known in the art (see, for example, Huynh et al. (2000) *J. Bacteriol.* 182:1895-902).

General stress proteins may include proteins in the phosphoenolpyruvate-dependent sugar phosphotransferase system. The bacterial phosphoenolpyruvate:sugar phosphotransferase system (PTS) is a multi-protein system involved in the regulation of a variety of metabolic and transcriptional processes. The PTS catalyzes the phosphorylation of incoming sugar substrates concomitant with their translocation across the cell membrane. The general mechanism of the PTS is the following: a phosphoryl group from phosphoenolpyruvate (PEP) is transferred to enzyme-I (EI) of PTS, which in turn transfers it to a phosphoryl carrier protein (HPr). Phospho-HPr then transfers the phosphoryl group to a sugar-specific permease. The sugar-specific permease of the phosphoenolpyruvate-dependent sugarphosphotransferase system (PTS) consists of at least three structurally distinct domains (IIA, IIB, and IIC) which can either be fused together in a single polypeptide chain or exist as two or three interactive chains. The IIA domain (PFAM Accession No. PF00358) carries the first permease-specific phosphorylation site, a histidine that is phosphorylated by phospho-HPr. The second domain (IIB) (PFAM Accession No. PF00367) is phosphorylated by phospho-IIA on a cysteinyl or histidyl residue, depending on the permease. Finally, the phosphoryl group is transferred from the IIB domain to the sugar substrate in a process catalyzed by the IIC domain (PFAM Accession No. PF02378); this process is coupled to the transmembrane transport of the sugar. Proteins of the present invention that are members of the phosphoenolpyruvate-dependent sugar phosphotransferase system, EIIA 1 family include those in SEQ ID NOS:64, 222, and 318. Proteins of the present invention that are members of the phosphotransferase system, EIIC family include those in SEQ ID NOS:64 and 318. Proteins of the present invention that are members of the phosphotransferase system, EIIB family include those in SEQ ID NOS:64 and 318. Methods to measure phosphotransferase activity are well known in the art (see, for example, Postma et al. (1993) *Microbiol. Rev.* 57:543-94).

General stress proteins may also include those in the bacterial regulatory proteins, GntR family (PFAM Accession No. PF00392). This family of regulatory proteins consists of the N-terminal 'helix-turn-helix' (HTH) region of GntR-like bacterial transcription factors. At the C-terminus there is usually an effector-binding/oligomerization domain. The GntR-like proteins can be divided into six sub-families: MocR, YtrR, FadR, AraR, HutC and PlmA. Many of these proteins have been shown experimentally to be autoregulatory, enabling the prediction of operator sites and the discovery of cis/trans relationships (Lee et al. (2003) *J. Bacteriol.* 185:4315-4325). Within this family, the HTH motif is situated towards the N-terminus. Proteins of the present invention that are members of the bacterial regulatory proteins, GntR family include that in SEQ ID NO:66. Methods to measure transcription factor activity are well known in the art (see, for example, Lee et al. (2000) *Eur. J. Biochem.* 267:7224-7230).

SEQ ID NO:140 is a member of the SelR domain family (PFAM Accession No. PF01641). This domain is found associated with the peptide methionine sulfoxide reductase enzymatic domain. Methionine sulfoxide reduction is an important process, by which cells regulate biological processes and cope with oxidative stress. MsrA, a protein involved in the reduction of methionine sulfoxides in proteins, has been known for four decades and has been extensively characterized with respect to structure and function. However, recent studies revealed that MsrA is only specific for methionine-5-sulfoxides. Because oxidized methionines occur in a mixture of R and S isomers in vivo, it was unclear how stereo-specific MsrA could be responsible for the reduction of all protein methionine sulfoxides. It appears that a second methionine sulfoxide reductase, SelR, evolved that is specific for methionine-R-sulfoxides, the activity that is different but complementary to that of MsrA. Thus, these proteins, working together, could reduce both stereoisomers of methionine sulfoxide. This domain is found both in SelR proteins and fused with the peptide methionine sulfoxide reductase enzymatic domain. The domain has two conserved cysteine and histidines. The domain binds both selenium and zinc (Lescure et al. (1999) *J. Biol. Chem.* 274:38147-54). The final cysteine is found to be replaced by the rare amino acid selenocysteine in some members of the family (Kryukov et al. (2002) *Proc. Natl. Acad. Sci. U.S.A.* 99:4245-50). This family has methionine-R-sulfoxide reductase activity. Methods to measure methionine-R-sulfoxide reductase activity are well known in the art (see, for example, Lescure et al., 1999, supra).

SEQ ID NO:146 is a member of the Histidine kinase-, DNA gyrase B-, and HSP90-like ATPase family (PFAM Accession No. PF02518). This domain is found in several ATP-binding proteins for example: histidine kinase, DNA gyrase B, topoisomerases, heat shock protein HSP90, phytochrome-like ATPases and DNA mismatch repair proteins. SEQ ID NO:146 is also a member of the His Kinase A (phosphoacceptor) domain family (PFAM Accession No. PF00512). The histidine kinase A (phosphoacceptor) N-terminal domain is a dimerization and phosphoacceptor domain of histidine kinases. It has been found in bacterial sensor protein/histidine kinases. SEQ ID NO:146 is also a member of the HAMP domain family (PFAM Accession No. PF00672). This domain is known as the HAMP domain for histidine kinases, adenylyl cyclases, methyl binding proteins and phosphatases. It is found in bacterial sensor and chemotaxis proteins and in eukaryotic histidine kinases. The bacterial proteins are usually integral membrane proteins and part of a two-component signal transduction pathway.

It is recognized that various proteins of the invention may be used in combination to engineer a *Lactobacillus* with enhanced survival or growth characteristics. In this manner at least one or multiple combinations of genes will be expressed for the desired characteristic. General stress-related proteins of the present invention include those in SEQ ID NOS:6, 8, 10, 12, 16, 24, 26, 32, 36, 42, 44, 50, 52, 56, 60, 62, 64, 66, 68, 76, 86, 88, 90, 92, 94, 96, 98, 100, 102, 104, 106, 108, 110, 112, 114, 116, 118, 120, 122, 124, 126, 128, 130, 132, 134, 136, 140, 146, 148, 312, 316, 318, 320, 322, 324, 326, 328, 330, 332, 334, 336, and 338.

The following examples are offered by way of illustration and not by way of limitation.

EXAMPLES

Example 1

Gapped BlastP Results for Amino Acid Sequences

A Gapped BlastP sequence alignment showed that SEQ ID NO:2 (480 amino acids) has about 37% identity from amino acids 20-477 with a protein from *Clostridium perfringens* that is homologous to a glutamate gamma-aminobutyrate antiporter (Accession Nos. NP_562976.1; NC_003366), about 39% identity from amino acids 20-471 with a protein from *Clostridium perfringens* that is homologous to an amino acid antiporter (Accession Nos. NP_562216.1; NC_003366), about 35% identity from amino acids 15-476 with a protein from *Lactococcus lactis* subsp. *lactis* that is a glutamate-gamma-aminobutyrate antiporter (Accession Nos. NP_267447.1; NC_002662), about 35% identity from amino acids 15-476 with a protein from *Lactococcus lactis* that is a glutamate/gamma-aminobutyrate antiporter (Accession No. sp|O30417|GADC), and about 37% identity from amino acids 20-476 with a protein from *Listeria innocua* that is homologous to an amino acid antiporter (acid resistance) (Accession Nos. NP_471792.1; NC_003212).

A Gapped BlastP sequence alignment showed that SEQ ID NO:4 (423 amino acids) has about 86% identity from amino acids 12-423 with a protein from *Lactobacillus helveticus* that is a serine protease do-like htrA (Accession No. sp|Q9Z4H7|HTRA_LACHE), about 41% identity from amino acids 17-421 with a protein from *Staphylococcus aureus* subsp. *aureus* that is homologous to a serine protease do, heat-shock protein htrA (Accession Nos. NP_374838.1; NC_002745), about 44% identity from amino acids 36-420 with a protein from *Streptococcus pneumoniae* that is a serine protease (Accession Nos. NP_346646.1; NC_003028), about 44% identity from amino acids 36-420 with a protein from *Streptococcus pneumoniae* that is a serine protease (Accession Nos. NP_359636.1; NC_003098), and about 40% identity from amino acids 38-421 with a protein from *Bacillus subtilis* that is a serine protease Do (heat-shock protein) (Accession Nos. NP_389173.1; NC_000964).

A Gapped BlastP sequence alignment showed that SEQ ID NO:6 (298 amino acids) has about 53% identity from amino acids 1-298 with a protein from *Streptococcus mutans* that is a protease HtpX-like protein (Accession No. gb|AALO4088.1), about 53% identity from amino acids 1-298 with a protein from *Streptococcus pyogenes* that is homologous to a heat shock protein (Accession Nos. NP_606582.1; NC_003485), about 53% identity from amino acids 1-298 with a protein from *Streptococcus pyogenes* that is homologous to a heat shock protein (Accession Nos. NP_268666.1; NC_002737), about 54% identity from amino acids 1-297 with a protein from *Streptococcus gordonii* that is homologous to a protease htpX (Accession No. sp|O30795|HTPX_STRGC), and about 53% identity from amino acids 1-298 with a protein from *Streptococcus pneumoniae* that is a heat shock protein (Accession Nos. NP_358755.1; NC_003098).

A Gapped BlastP sequence alignment showed that SEQ ID NO:8 (262 amino acids) has about 46% identity from amino acids 3-256 with a protein from *Bacillus subtilis* that is homologous to a tellurium resistance protein (Accession Nos. NP_388174.1; NC_000964), about 42% identity from amino acids 3-253 with a protein from *Clostridium acetobutylicum* that is a TerC family protein, with homology to a stress response protein (Accession Nos. NP_348043.1; NC_003030), about 32% identity from amino acids 28-257 with a putative protein from *Bacillus megaterium* (Accession Nos. gb|AAD05253.1; AF109909), about 32% identity from amino acids 28-221 with a protein from *Bacillus subtilis* that is homologous to a toxic anion resistance protein (Accession Nos. NP_389227.1; NC_000964), and about 36% identity from amino acids 28-221 with a protein from *Staphylococcus aureus* subsp. *aureus* that is homologous to a toxic anion resistance protein (Accession Nos. NP_371546.1; NC_002758).

A Gapped BlastP sequence alignment showed that SEQ ID NO:10 (485 amino acids) has about 44% identity from amino acids 15-485 with a protein from *Lactococcus lactis* subsp. *lactis* that is a cardiolipin synthase (Accession Nos. NP_267330.1; NC 002662), about 41% identity from amino acids 10-485 with a protein from *Listeria innocua* that is homologous to a cardiolipin synthase (Accession Nos. NP_471976.1; NC_003212), about 40% identity from amino acids 10-485 with a protein from *Listeria monocytogenes* that is homologous to a cardiolipin synthase (Accession Nos. NP_466026.1; NC_003210), about 38% identity from amino acids 8-485 with a protein from *Bacillus subtilis* that is homologous to a cardiolipin synthase (Accession Nos. NP_391540.1; NC_000964), and about 40% identity from amino acids 12-485 with a hypothetical protein from *Staphylococcus aureus* subsp. *aureus* with homology to a cardiolipin synthetase (Accession Nos. NP_375196.1; NC_002745).

A Gapped BlastP sequence alignment showed that SEQ ID NO:12 (457 amino acids) has about 99% identity from amino acids 1-457 with a protein from *Lactobacillus acidophilus* that is an SB-protein (Accession Nos. CAA61561.1; X89376), about 57% identity from amino acids 1-457 with a protein from *Lactobacillus acidophilus* that is an s-layer protein precursor (Accession No. sp|P35829|SLAP_LACAC), about 49% identity from amino acids 1-456 with a protein from *Lactobacillus helveticus* that is a surface layer protein (Accession Nos. emb|CAB46985.1; AJ388559), about 49% identity from amino acids 1-456 with a protein from *Lactobacillus helveticus* that is a surface layer protein (Accession Nos. emb|CAB46984.1; AJ388558), and about 49% identity from amino acids 1-456 with a protein from *Lactobacillus helveticus* that is a surface layer protein (Accession Nos. emb|CAB46986.1; AJ388560).

A Gapped BlastP sequence alignment showed that SEQ ID NO:14 (147 amino acids) has about 52% identity from amino acids 34-147 with a protein from *Lactobacillus delbrueckii* that is homologous to a heat shock protein (Accession Nos. emb|CAA96463.1; Z71782), about 39% identity from amino acids 7-147 with a protein from *Streptococcus thermophilus* that is a heat shock protein (HSP 16.4) (Accession No. sp|O30851|ASP2), about 42% identity from amino acids 7-134 with a protein from *Oenococcus oeni* that is a heat shock protein (Accession Nos. emb|CAA67831.1; X99468), about 42% identity from amino acids 23-147 with a protein from *Streptococcus thermophilus* that is a low molecular weight heat stress protein (Accession Nos. NP_051024.1; NC_000937), and about 41% identity from amino acids 23-147 with a protein from *Streptococcus thermophilus* that is homologous to a small heat shock protein (Accession Nos. emb|CAB46549.1; AJ242477).

A Gapped BlastP sequence alignment showed that SEQ ID NO:16 (184 amino acids) has about 53% identity from amino acids 3-135 with a protein from *Streptococcus pyogenes* that is homologous to a DNA-directed RNA polymerase delta subunit (Accession Nos. NP_607952.1; NC_003485), about 53% identity from amino acids 3-135 with a protein from *Streptococcus pyogenes* that is homologous to a DNA-directed RNA polymerase (delta subunit) (Accession Nos. NP_269882.1; NC_002737), about 57% identity from amino acids 13-112 with a protein from *Lactococcus lactis* subsp. *lactis* that is a DNA-directed RNA polymerase delta chain (EC 2.7.7.6) (Accession Nos. NP_266790.1; NC_002662), about 42% identity from amino acids 3-168 with a protein from *Streptococcus pneumoniae* that is homologous to a DNA-directed RNA polymerase, delta subunit (Accession Nos. NP_345011.1; NC_003028), and about 50% identity from amino acids 3-91 with a protein from *Listeria monocytogenes* that is homologous to an RNA polymerase delta subunit (Accession Nos. NP_466083.1; NC_003210).

A Gapped BlastP sequence alignment showed that SEQ ID NO:18 (723 amino acids) has about 62% identity from amino acids 6-659 with a protein from *Streptococcus pneumoniae* that is a cell division protein FtsH (Accession Nos. NP_344566.1; NC_003028), about 62% identity from amino acids 6-659 with a protein from *Streptococcus pneumoniae* that is a cell-division protein/general stress protein (class III heat shock) (Accession Nos. NP_357606.1; NC 003098), about 59% identity from amino acids 6-665 with a protein from *Streptococcus pyogenes* that is homologous to a cell division protein (Accession Nos. NP_268434.1; NC_002737), about 59% identity from amino acids 6-665 with a protein from *Streptococcus pyogenes* that is homologous to a cell division protein (Accession Nos. NP_606348.1; NC_003485), and about 58% identity from amino acids 6-657 with a protein from *Lactococcus lactis* subsp. *lactis* that is a cell division protein FtsH (Accession Nos. NP_266177.1; NC_002662).

A Gapped BlastP sequence alignment showed that SEQ ID NO:20 (825 amino acids) has about 52% identity from amino acids 1-811 with a protein from *Listeria monocytogenes* that is an endopeptidase Clp ATP-binding chain C (Accession Nos. NP_463763.1; NC_003210), about 52% identity from amino acids 1-811 with a protein from *Listeria innocua* that is an endopeptidase Clp ATP-binding chain C (Accession Nos. NP_469609.1; NC_003212), about 51% identity from amino acids 1-811 with a protein from *Listeria monocytogenes* that is a ClpC ATPase (Accession Nos. gb|AAC44446.1; U40604), about 51% identity from amino acids 1-810 with a protein from *Bacillus halodurans* that is a class III stress response-related ATPase (Accession Nos. NP_240969.1; NC_002570), and about 49% identity from amino acids 6-822 with a protein from *Staphylococcus aureus* subsp. *aureus* that is an endopeptidase (Accession Nos. NP_371049.1; NC_002758).

A Gapped BlastP sequence alignment showed that SEQ ID NO:22 (296 amino acids) has about 46% identity from amino acids 1-291 with a conserved hypothetical protein from *Listeria monocytogenes* (Accession Nos. NP_463753.1; NC_003210), about 46% identity from amino acids 1-279 with a conserved hypothetical protein from *Listeria innocua* (Accession Nos. NP_469599.1; NC_003212), about 45% identity from amino acids 2-287 with a protein from *Staphylococcus aureus* subsp. *aureus* that is homologous to a heat-shock protein HSP33 (Accession Nos. NP_371036.1; NC_002758), about 42% identity from amino acids 1-286 with a protein from *Geobacillus stearothermophilus* that is a 33 kDa chaperonin (Accession No. sp|Q9F984|HSLO_BACST), and about 43% identity from amino acids 3-284 with a protein from *Bacillus subtilis* that is a 33 kDa chaperonin (Accession No. sp|P37565|HSLO_BACSU).

A Gapped BlastP sequence alignment showed that SEQ ID NO:24 (412 amino acids) has about 43% identity from amino acids 49-399 with a protein from *Streptococcus pneumoniae* that is a DNA-damage-inducible protein P (Accession Nos. NP_358008.1; NC_003098), about 44% identity from amino acids 53-399 with a protein from *Streptococcus pneumoniae* that is a DNA-damage inducible protein P (Accession Nos. NP_344978.1; NC_003028), about 43% identity from amino acids 49-400 with a protein from *Streptococcus pyogenes* that is homologous to a DNA-damage-inducible protein P (Accession Nos. NP_607913.1; NC_003485), about 43% identity from amino acids 49-399 with a protein from *Lactococcus lactis* subsp. *lactis* that is a DNA-damage-inducible protein P (Accession Nos. NP_268186.1; NC_002662), and about 43% identity from amino acids 49-400 with a protein from *Streptococcus pyogenes* that is homologous to a DNA-damage-inducible protein P (Accession No. NP_269845.1; NC_002737).

A Gapped BlastP sequence alignment showed that SEQ ID NO:26 (178 amino acids) has about 30% identity from amino acids 7-116 with a protein from *Bacillus halodurans* that is an RNA polymerase sigma-H factor (sigma-30) (Accession Nos. NP_240981.1; NC_002570), about 28% identity from amino acids 4-126 with a protein from *Bacillus subtilis* that is an RNA polymerase sigma-30 factor (sigma-H) (Accession Nos. NP_387979.1; NC_000964), about 28% identity from amino acids 4-116 with a protein from *Bacillus licheniformis* that is an RNA polymerase sigma-H factor (sigma-30) (Accession No. sp|P02964|RPSH_BACLI), about 27% identity from amino acids 3-85 with a protein from *Vibrio cholerae* that is an RNA polymerase sigma-E factor (Accession Nos. NP_232096.1; NC_002505), and 30% identity from amino acids 6-86 with a hypothetical protein from *Clostridium perfriligens* (Accession Nos. NP_561423.1; NC_003366).

A Gapped BlastP sequence alignment showed that SEQ ID NO:28 (94 amino acids) has about 98% identity from amino acids 1-94 with a protein from *Lactobacillus acidophilus* that is a cochaperonin GroES (Accession Nos. gb|AAK97217.1; AF300645), about 90% identity from amino acids 1-94 with a protein from *Lactobacillus helveticus* that is a cochaperonin GroES (Accession Nos. gb|AAC29003.1; AF031929), about 69% identity from amino acids 1-94 with a protein from *Lactobacillus johnsonii* that is a GroES protein (Accession Nos. gb|AAF75592.1; AF214488), about 72% identity from amino acids 1-92 with a protein from *Lactobacillus zeae* that is a GroES protein (Accession Nos. gb|AAB66325.1; AF010281), and 61% identity from amino acids 1-91 with a protein from *Enterococcus faecalis* that is a GroES protein (Accession Nos. gb|AAL04032.1; AF335185).

A Gapped BlastP sequence alignment showed that SEQ ID NO:30 (542 amino acids) has about 98% identity from amino acids 1-528 with a protein from *Lactobacillus acidophilus* that is a chaperonin GroEL (Accession Nos. gb|AAK97218.1; AF300645), about 93% identity from amino acids 1-540 with a protein from *Lactobacillus helveticus* that is a 60 kDa chaperonin (Protein Cpn60) (groEL protein) (Accession No. sp|O68324|CH60_LACHE), about 84% identity from amino acids 1-542 with a protein from *Lactobacillus johnsonii* that is a GroEL protein (Accession Nos. gb|AAF75593.1; AF214488), about 81% identity from amino acids 1-524 with a protein from *Lactobacillus zeae* that is a GroEL protein (Accession Nos. gb|AAB66326.1; AF010281), and 74% identity from amino acids 1-542 with a protein from *Enterococcus faecalis* that is a GroEL protein (Accession Nos. gb|AAL04033.1; AF335185).

A Gapped BlastP sequence alignment showed that SEQ ID NO:32 (333 amino acids) has about 77% identity from amino acids 1-333 with a protein from *Lactobacillus delbrueckii* subsp. *bulgaricus* that is a pepRI (Accession Nos. emb|CAB76946.1; Y13385), about 77% identity from amino acids 1-333 with a protein from *Lactobacillus delbrueckii* subs. *lactis* that is a transcription regulatory protein (PepRI) (Accession No. sp|Q48544|PEPR_LACDL), about 50% identity from amino acids 1-330 with a protein from *Lactobacillus pentosus* that is a catabolite control protein A (Accession Nos. gb|AAD53119.1; AF176799), about 49% identity from amino acids 1-330 with a protein from *Enterococcus faecalis* that is a catabolite regulator protein (Accession Nos. emb|CAAO9491.1; AJO 1113), and 49% identity from amino acids 1-330 with a protein from *Lactobacillus casei* that is a Ccpa protein (Accession Nos. gb|AAC46030.1; U28137).

A Gapped BlastP sequence alignment showed that SEQ ID NO:34 (294 amino acids) has about 37% identity from amino acids 1-294 with a protein from *Streptococcus pyogenes* that is homologous to a thioredoxin reductase (Accession Nos. NP_269057.1; NC_002737), about 37% identity from amino acids 1-294 with a protein from *Streptococcus pyogenes* that is homologous to a thioredoxin reductase (Accession Nos. NP_607060.1; NC_003485), about 37% identity from amino acids 8-294 with a protein from *Listeria innocua* that is homologous to a thioredoxine reductase (Accession Nos. NP_471819.1; NC_003212), about 36% identity from amino acids 8-294 with a protein from *Listeria monocytogenes* that is homologous to a thioredoxine reductase (Accession Nos. NP_465913.1; NC_003210), and 36% identity from amino acids 8-294 with a protein from *Streptococcus pneumoniae* that is a thioredoxin reductase (Accession Nos. NP_359014.1; NC_003098).

A Gapped BlastP sequence alignment showed that SEQ ID NO:36 (322 amino acids) has about 70% identity from amino acids 1-314 with a protein from *Lactobacillus delbrueckii* that is an HprK (Accession Nos. gb|AAL14784.1; AF320250), about 59% identity from amino acids 1-322 with a protein from *Lactobacillus casei* that is an HprK protein (Accession Nos. emb|CAB65151.1; Y18948), about 55% identity from amino acids 1-313 with a protein from *Lactobacillus brevis* that is a PtsK (Accession Nos. gb|AAK54064.1; AF343443), about 55% identity from amino acids 5-313 with a protein from *Enterococcus faecalis* that is a HPr(Ser) kinase/phosphatase (Accession No. sp|O07664|HPRK_ENTFA), and 54% identity from amino acids 30-311 with a protein from *Listeria innocua* that is a HPr-P(Ser) kinase/phosphatase (Accession Nos. NP_471956.1; NC_003212).

A Gapped BlastP sequence alignment showed that SEQ ID NO:38 (314 amino acids) has about 66% identity from amino acids 7-310 with a protein from *Lactobacillus delbrueckii* that is a TrxB (Accession Nos. gb|AAL14787.1; AF320250), about 56% identity from amino acids 11-310 with a protein from *Streptococcus pyogenes* that is a thioredoxin reductase (Accession Nos. NP_607711.1; NC_003485), about 55% identity from amino acids 11-313 with a protein from *Bacillus subtilis* that is a thioredoxin reductase (EC 1.6.4.5) (Accession Nos. NP_391359.1; NC_000964), about 55% identity from amino acids 11-311 with a protein from *Streptococcus pneumoniae* that is a thioredoxin reductase (Accession No. NP_358905.1; NC_003098), and 55% identity from amino acids 11-311 with a protein from *Streptococcus pneumoniae* that is a thioredoxin reductase (Accession Nos. NP_345912.1; NC_003028).

A Gapped BlastP sequence alignment showed that SEQ ID NO:40 (195 amino acids) has about 74% identity from amino acids 2-190 with a protein from *Staphylococcus aureus* subsp. *aureus* that is an ATP-dependent Clp protease proteolytic subunit (Accession No. sp|Q99VK9|CLPP_STAAU), about 70% identity from amino acids 2-192 with a protein from *Listeria innocua* that is an ATP-dependent Clp protease proteolytic subunit (Accession Nos. NP_471942.1; NC_003212), about 69% identity from amino acids 2-192 with a protein from *Listeria monocytogenes* that is an ATP-dependent Clp protease proteolytic subunit (Accession Nos. NP_465991.1; NC_003210), about 69% identity from amino acids 2-192 with a protein from *Bacillus thuringiensis* that is a ClpP1 (Accession Nos. gb|AAL51030.1; AF454757), and 67% identity from amino acids 1-189 with aprotein from *Campylobacter jejuni* that is an ATP-dependent clp protease proteolytic subunit (Accession Nos. NP_281402.1; NC_002163).

A Gapped BlastP sequence alignment showed that SEQ ID NO:42 (338 amino acids) has about 88% identity from amino acids 1-338 with a protein from *Lactobacillus delbrueckii* that is a glyceraldehyde 3-phosphate dehydrogenase (GAPDH) (Accession No. sp|O32755|G3P_LACDE), about 66% identity from amino acids 4-338 with a protein from *Escherichia coli* that is a glyceraldehyde-3-phosphate dehydrogenase (Accession Nos. NP_287745.1; NC_002655), about 66% identity from amino acids 4-338 with a protein from *Escherichia coli* that is a glyceraldehyde 3-phosphate dehydrogenase C. (GAPDH-C)(Accession No. sp|P33898|G3P3), about 61% identity from amino acids 1-336 with a protein from *Neisseria meningitidis* that is a glyceraldehyde 3-phosphate dehydrogenase (Accession Nos. NP_275144.1; NC_003112), and 61% identity from amino acids 1-336 with a protein from *Neisseria meningitidis* that is a glyceraldehyde 3-phosphate dehydrogenase C (Accession Nos. NP_283086.1; NC_003116).

A Gapped BlastP sequence alignment showed that SEQ ID NO:44 (154 amino acids) has about 56% identity from amino acids 1-147 with a conserved hypothetical protein from *Streptococcus pneumoniae* (Accession Nos. NP_359402.1; NC_003098), about 56% identity from amino acids 1-147 with a protein from *Streptococcus pneumoniae* that is in the universal stress protein family (Accession Nos. NP_346423.1; NC_003028), about 52% identity from amino acids 1-146 with a protein from *Listeria monocytogenes* (Accession Nos. NP_465105.1; NC_003210), about 50% identity from amino acids 1-144 with a conserved hypothetical protein from *Streptococcus pyogenes* (Accession Nos. NP_607864.1; NC_003485), and 52% identity from amino acids 1-144 with a protein from *Listeria innocua* (Accession Nos. NP_470951.1; NC_003212).

A Gapped BlastP sequence alignment showed that SEQ ID NO:46 (414 amino acids) has about 35% identity from amino acids 16-404 with a protein from *Streptococcus pyogenes* that is homologous to a cell division protein (Accession Nos. NP_268864.1; NC_002737), about 35% identity from amino acids 24-404 with a protein from *Streptococcus pyogenes* that is homologous to a cell division protein (Accession Nos. NP_606853.1; NC_003485), about 36% identity from amino acids 24-407 with a protein from *Streptococcus pneumoniae* that is homologous to cell division protein FtsW (Accession Nos. NP_345540.1; NC_003028), about 36% identity from amino acids 24-407 with a protein from *Streptococcus pneumoniae* that is a cell division protein FtsW (Accession Nos. NP_358567.1; NC_003098), and 35% identity from amino acids 24-404 with a protein from *Lactococcus lactis* that is a cell division protein FtsW (Accession Nos. NP_266824.1; NC_002662).

A Gapped BlastP sequence alignment showed that SEQ ID NO:48 (420 amino acids) has about 63% identity from amino acids 4-413 with a protein from *Bacillus halodurans* that is an ATP-dependent Clp protease ATP-binding subunit (class III heat-shock protein) (Accession Nos. NP_243918.1; NC_002570), about 63% identity from amino acids 4-414 with a protein from *Clostridium perfringens* that is an ATP-dependent Cip protease ATP-binding subunit (Accession Nos. NP_562308.1; NC_003366), about 64% identity from amino acids 1-403 with a protein from *Streptococcus pyogenes* that is homologous to an ATP-dependent Clp protease subunit X (Accession Nos. NP_269084.1; NC 002737), about 62% identity from amino acids 7-413 with a protein from *Bacillus subtilis* that is a ClpX protein (Accession Nos. emb|CAA64618.1; X95306), and 62% identity from amino acids 4-414 with a protein from *Clostridium acetobutylicum* that is an ATP-dependent protease Clp, ATPase subunit ClpX (Accession Nos. NP_349246.1; NC_003030).

A Gapped BlastP sequence alignment showed that SEQ ID NO:50 (456 amino acids) has about 58% identity from amino acids 32-451 with a protein from *Bacillus subtilis* that is a diaminopimelate decarboxylase (DAP decarboxylase) (Accession No. sp|P23630|DCDA_BACSU), about 58% identity from amino acids 32-451 with a protein from *Bacillus subtilis* that is a diaminopimelate decarboxylase (Accession Nos. NP_390219.1; NC_000964), about 57% identity from amino acids 30-444 with a protein from *Bacillus methanolicus* that is a diaminopimelate decarboxylase (Accession No. sp|P41023|DCDA), about 55% identity from amino acids 31-451 with a protein from *Listeria monocytogenes* that is homologous to a diaminopimelate decarboxylase (Accession Nos. NP_465476.1; NC_003210), and 55% identity from amino acids 31-451 with a protein from *Listeria innocua* that is homologous to a diaminopimelate decarboxylase (Accession Nos. NP_471400.1; NC_003212).

A Gapped BlastP sequence alignment showed that SEQ ID NO:52 (267 amino acids) has about 26% identity from amino acids 1-200 with a hypothetical protein from *Lactobacillus helveticus* (Accession Nos. NP_052190.1; NC_002102), about 36% identity from amino acids 1-65 with a conserved hypothetical protein from *Thermotoga maritima* (Accession Nos. NP_228465.1; NC_000853), about 31% identity from amino acids 1-113 with a hypothetical protein from *Clostridium perfringens* that has a 3 nanH region (Accession No. pir||I40868), about 37% identity from amino acids 3-99 with a protein from *Nostoc* sp. PCC 7120 that is a transcriptional regulator (Accession Nos. NP_487002.1; NC_003272), and 23% identity from amino acids 4-186 with a protein from *Listeria innocua* that is homologous to a transcriptional regulator (Accession Nos. NP_469695.1; NC_003212).

A Gapped BlastP sequence alignment showed that SEQ ID NO:54 (749 amino acids) has about 54% identity from amino acids 4-749 with a protein from *Listeria innocua* that is homologous to a (p)ppGpp synthetase (Accession Nos. NP_470894.1; NC_003212), about 54% identity from amino acids 4-749 with a protein from *Listeria monocytogenes* that is homologous to a (p)ppGpp synthetase (Accession Nos. NP_465048.1; NC_003210), about 54% identity from amino acids 4-749 with a protein from *Listeria monocytogenes* that is a Rel protein (Accession Nos. dbj|BAB60670.1; AB051847), about 51% identity from amino acids 4-748 with a protein from *Lactococcus lactis* subsp. *lactis* that is a ppGpp synthetase I (EC 2.7.6.5) (Accession Nos. NP_266262.1; NC_002662), and 52% identity from amino acids 10-748 with a protein from *Lactococcus lactis* that is homologous to a GTP pyrophosphokinase RelA (Accession Nos. gb|AAL58286.1; AF188107).

A Gapped BlastP sequence alignment showed that SEQ ID NO:56 (174 amino acids) has about 81% identity from amino acids 1-174 with a protein from *Lactobacillus leichmannii* that is a heat shock induced protein HtpI (Accession Nos. emb|CAA59019.1; X84261), about 57% identity from amino acids 2-174 with a protein from *Listeria innocua* that is homologous to a beta-type subunit of the 20S proteasome (Accession Nos. NP_470653.1; NC_003212), about 56% identity from amino acids 2-174 with a protein from *Listeria monocytogenes* that is homologous to a beta-type subunit of the 20S proteasome (Accession Nos. NP_464803.1; NC_003210), about 54% identity from amino acids 2-174 with a protein from *Staphylococcus aureus* subsp. *aureus* that is a heat shock protein HslV (Accession Nos. NP_371777.1; NC_002758), and 51% identity from amino acids 2-174 with a protein from *Bacillus halodurans* that is a beta-type subunit of the 20S proteasome (Accession Nos. NP_243330.1; NC_002570).

A Gapped BlastP sequence alignment showed that SEQ ID NO:58 (466 amino acids) has about 77% identity from amino acids 1-466 with a protein from *Lactobacillus leichmannii* that is a ATP-dependent hs1 protease ATP-binding subunit hslU (Accession No. sp|Q48735|HSLU_LACLE), about 75% identity from amino acids 1-391 with a protein from *Lactobacillus leichmannii* that is a heat shock induced protein HtpO (Accession Nos. emb|CAA59020.1; X84261), about 57% identity from amino acids 5-466 with a protein from *Listeria monocytogenes* that is homologous to an ATP-dependent Clp protease (Accession Nos. NP_464804.1; NC_003210), about 58% identity from amino acids 3-466 with a protein from *Bacillus haloclurans* that is a ATP-dependent Clp protease (heat-shock protein) (Accession Nos. NP_243329.1; NC_002570), and 58% identity from amino acids 5-466 with a protein from *Bacillus subtilis* that is a codX protein (Accession No. pir||S61495).

A Gapped BlastP sequence alignment showed that SEQ ID NO:60 (495 amino acids) has about 38% identity from amino acids 23-487 with a protein from *Salmonella enterica* subsp. *enterica* serovar Typhi that is homologous to a transport protein (Accession Nos. NP_455457.1; NC_003198), about 36% identity from amino acids 25-491 with a protein from *Lactococcus lactis* subsp. *lactis* that is an amino acid permease (Accession Nos. NP_267266.1; NC_002662), about 37% identity from amino acids 23-487 with a protein from *Salmonella typhimurium* that is homologous to an APC family, amino-acid transporter (Accession Nos. NP_459944.1; NC_003197), about 36% identity from amino acids 23-491 with a protein from *Escherichia coli* K12 that is a putative transport protein (Accession Nos. NP_415419.1; NC_000913), and 36% identity from amino acids 23-491 with a protein from *Escherichia coli* that is a hypothetical 52.5 kDa protein in the DMSC—PFLA intergenic region (Accession No. sp|P75835|YCAM).

A Gapped BlastP sequence alignment showed that SEQ ID NO:62 (697 amino acids) has about 48% identity from amino acids 48-685 with a protein from *Lactobacillus* sp. that is an ornithine decarboxylase (Ec: 4.1.1.17) (Accession No. pdb|1ORD|A), about 48% identity from amino acids 48-685 with a protein from *Lactobacillus* sp. that is an ornithine decarboxylase, inducible (ODC) (EC 4.1.1.17) (Accession No. sp|P43099|DCOR_LACS3), about 48% identity from amino acids 48-685 with a protein from *Lactobacillus* sp. 30A that is an ornithine decarboxylase mutant (Glyl21Tyr) (Accession No. pdb|1C4K|A), about 43% identity from amino acids 1-695 with a protein from *Haemophilus influenzae* that is an ornithine decarboxylase (speF) (Accession Nos. NP_438749.1; NC_000907), and 42% identity from amino acids 33-696 with a protein from *Escherichia coli* that is an ornithine decarboxylase isozyme (Accession Nos. NP_289537.1; NC_002655).

A Gapped BlastP sequence alignment showed that SEQ ID NO:64 (667 amino acids) has about 42% identity from amino acids 192-661 with a protein from *Lactococcus lactis* subsp. *lactis* that is a beta-glucoside-specific PTS system IIABC component (EC 2.7.1.69) (Accession Nos. NP_266583.1; NC_002662), about 39% identity from amino acids 191-652 with a protein from *Listeria monocytogenes* that is homologous to a phosphotransferase system (PTS) beta-glucoside-specific enzyme IIABC (Accession Nos. NP_464560.1; NC_003210), about 37% identity from amino acids 191-662 with a protein from *Clostridium longisporum* that is a PTS-dependent enzyme II (Accession Nos. gb|AAC05713.1; L49336), about 36% identity from amino acids 191-666 with a protein from *Bacillus halodurans* that is a PTS system, beta-glucoside-specific enzyme II, ABC component (Accession Nos. NP_241461.1; NC_002570), and 36% identity from amino acids 191-650 with a protein from *Listeria innocua* that is homologous to a PTS system, beta-glucosides specific enzyme IIABC (Accession Nos. NP_469373.1; NC_003212).

A Gapped BlastP sequence alignment showed that SEQ ID NO:66 (241 amino acids) has about 47% identity from amino acids 1-238 with a protein from *Bacillus subtilis* that is a trehalose operon transcriptional repressor (Accession No. sp|P39796|TRER_BACSU), about 41% identity from amino acids 4-238 with a protein from *Bacillus halodurans* that is a transcriptional repressor of the trehalose operon (Accession Nos. NP_241739.1; NC_002570), about 44% identity from amino acids 9-237 with a protein from *Listeria innocua* that is homologous to a transcription regulator GntR family (Accession Nos. NP_470558.1; NC_003212), about 44% identity from amino acids 9-237 with a protein from *Listeria monocytogenes* that is homologous to a transcription regulator GntR family (Accession Nos. NP_464778.1; NC_003210), and 41% identity from amino acids 5-238 with aprotein from *Lactococcus lactis* subsp. *lactis* that is a GntR family transcriptional regulator (Accession Nos. NP_266581.1; NC_002662).

A Gapped BlastP sequence alignment showed that SEQ ID NO:68 (570 amino acids) has about 56% identity from amino acids 22-566 with a protein from *Streptococcus pyogenes* that is homologous to a dextran glucosidase (Accession Nos. NP_608103.1; NC_003485), about 57% identity from amino acids 23-568 with a protein from *Streptococcus pneumoniae* that is a dextran glucosidase (Accession Nos. NP_359290.1; NC_003098), about 56% identity from amino acids 22-566 with a protein from *Streptococcus pyogenes* that is homologous to a dextran glucosidase (Accession Nos. NP_270026.1; NC_002737), about 57% identity from amino acids 23-568 with a protein from *Streptococcus pneumoniae* that is homologous to a dextran glucosidase DexS (Accession Nos. NP_346315.1; NC_003028), and 54% identity from amino acids 17-570 with a protein from *Clostridium perfringens* that is an alpha-glucosidase (Accession Nos. NP_561478.1; NC_003366).

A Gapped BlastP sequence alignment showed that SEQ ID NO:70 (164 amino acids) has about 42% identity from amino acids 2-163 with a protein from *Bacillus subtilis* that is homologous to a thiol peroxidase (Accession Nos. NP_390827.1; NC_000964), about 44% identity from amino acids 2-153 with a protein from *Listeria innocua* that is homologous to a thiol peroxidase (Accession Nos. NP_470961.1; NC_003212), about 44% identity from amino acids 2-153 with a protein from *Listeria monocytogenes* that is homologous to a thiol peroxidase (Accession Nos. NP_465108.1; NC_003210), about 40% identity from amino acids 4-163 with a protein from *Streptococcus parasanguis* that is homologous to a thiol peroxidase (Accession No. sp|P31307|TPX_STRPA), and 42% identity from amino acids 3-153 with a protein from *Bacillus halodurans* that is a thioredoxin peroxidase (Accession Nos. NP_244060.1; NC_002570).

A Gapped BlastP sequence alignment showed that SEQ ID NO:72 (443 amino acids) has about 32% identity from amino acids 1-443 with ORF454 from *Staphylococcus sciuri* (Accession Nos. emb|CAA73495.1; Y13052), about 33% identity from amino acids 4-441 with a protein from *Listeria innocua* that is homologous to a glutathione reductase (Accession Nos. NP_470808.1; NC_003212), about 33% identity from amino acids 4-441 with a protein from *Listeria monocytogenes* that is homologous to a glutathione reductase (Accession Nos. NP_464958.1; NC_003210), about 31% identity from amino acids 1-432 with ORF503 from *Staphylococcus sciuri* (Accession Nos. emb|CAA73535.1; Y13094), and 35% identity from amino acids 4-442 with a protein from *Lactococcus* lactis subsp. *lactis* that is a glutathione reductase (EC 1.6.4.2) (Accession Nos. NP_267002.1; NC_002662).

A Gapped BlastP sequence alignment showed that SEQ ID NO:74 (319 amino acids) has about 62% identity from amino acids 11-313 with a protein from *Streptococcus pneumoniae* that is a PhoH family protein (Accession Nos. NP_345431.1; NC_003028), about 60% identity from amino acids 13-313 with a protein from *Listeria innocua* that is homologous to a phosphate starvation induced protein PhoH (Accession Nos. NP_470840.1; NC_003212), about 60% identity from amino acids 11-313 with a protein from *Streptococcus pyogenes* that is a phosphate starvation-induced protein (Accession Nos. NP_268762.1; NC_002737), about 60% identity from amino acids 11-313 with a protein from *Streptococcus pyogenes* that is a phosphate starvation-induced protein (Accession Nos. NP_606731.1; NC_003485), and 59% identity from amino acids 6-315 with a protein from *Lactococcus* lactis subsp. *lactis* that is a phosphate starvation inducible protein (Accession Nos. NP_267240.1; NC_002662).

A Gapped BlastP sequence alignment showed that SEQ ID NO:76 (262 amino acids) has about 33% identity from amino acids 5-251 with a protein from *Thermotoga maritima* that is a homoserine O-succinyltransferase (Accession Nos. NP_228689.1; NC_000853), about 32% identity from amino acids 5-251 with a protein from *Vibrio cholerae* that is a homoserine O-succinyltransferase (Accession Nos. NP_231251.1; NC_002505), about 33% identity from amino acids 5-251 with a protein from *Salmonella enterica* subsp. *enterica* serovar Typhi that is a homoserine O-succinyltransferase (Accession Nos. NP_458502.1; NC_003198), about 32% identity from amino acids 5-251 with a protein from *Vibrio cholerae* that is a homoserine o-succinyltransferase (homoserine o-transsuccinylase) (Accession No. sp|Q9KRM5|META_VIBCH), and 31% identity from amino acids 5-251 with a protein from *Bacillus halodurans* that is a homoserine O-succinyltransferase (Accession Nos. NP_243146.1; NC_002570).

A Gapped BlastP sequence alignment showed that SEQ ID NO:78 (384 amino acids) has about 52% identity from amino acids 3-380 with a protein from *Lactobacillus sakei* that is a chaperone protein dnaJ (Accession No. sp|O87778|DNAJ_LACSK), about 51% identity from amino acids 1-384 with a protein from *Geobacillus thermoglucosidasius* that is a dnaJ protein (Accession Nos. dbj|BABO3216.1; AB017035), about 51% identity from amino acids 1-381 with a protein from *Streptococcus pneumoniae* that is a DnaJ protein homologue (Accession Nos. dbj|BAB16032.1; AB030809), about 51% identity from amino acids 1-381 with a protein from *Streptococcus pyogenes* that is a heat-shock (chaperone) protein (Accession Nos. NP_607849.1; NC_003485), and 51% identity from amino acids 1-381 with a protein from *Streptococcus pyogenes* that is a heat-shock (chaperone) protein (Accession Nos. NP_269779.1; NC_002737).

A Gapped BlastP sequence alignment showed that SEQ ID NO:80 (614 amino acids) has about 96% identity from amino acids 1-605 with a protein from *Lactobacillus acidophilus* that is a heat shock protein DnaK (Accession Nos. gb|AAK97221.1; AF300646), about 79% identity from amino acids 1-614 with a protein from *Lactobacillus sakei* that is a chaperone protein dnaK (Heat shock protein 70) (Accession No. sp|O87777|DNAK_LACSK), about 74% identity from amino acids 1-575 with a protein from *Bacillus stearothermophilus* that is a chaperone protein dnaK (Heat shock protein 70) (Accession No. sp|Q45551|DNAK_BACST), about 74% identity from amino acids 1-607 with a protein from *Streptococcus pneumoniae* that is a chaperone protein Dna K (heat shock protein 70) (Accession No. sp|P95829|DNAK_STRPN), and 74% identity from amino acids 1-607 with a protein from *Streptococcus pneumoniae* that is a dnaK protein (Accession Nos. NP_345035.1; NC_003028).

A Gapped BlastP sequence alignment showed that SEQ ID NO:82 (194 amino acids) has about 92% identity from amino acids 1-194 with a protein from *Lactobacillus acidophilus* that is a cochaperonin GrpE (Accession Nos. gb|AAK97220.1; AF300646), about 52% identity from amino acids 4-194 with a protein from *Lactobacillus sakei* that is a GrpE protein (HSP-70 cofactor) (Heat shock protein 70) (Accession No. sp|O87776|GRPE_LACSK), about 48% identity from amino acids 9-194 with a protein from *Tetragenococcus halophilus* that is a GrpE (Accession Nos. dbj|BAB63289.1; AB070346), about 44% identity from amino acids 22-194 with a protein from *Lactococcus lactis* that is a grpE protein (Accession No. pir||S39341), and 46% identity from amino acids 28-192 with a protein from *Streptococcus pneumoniae* that is a heat shock protein GrpE (Accession Nos. NP_345034.1; NC_003028).

A Gapped BlastP sequence alignment showed that SEQ ID NO:84 (349 amino acids) has about 50% identity from amino acids 1-348 with a protein from *Lactobacillus sakei* that is a heat-inducible transcription repressor hrcA (Accession No. sp|087775|HRCA_LACSK), about 45% identity from amino acids 1-345 with a protein from *Tetragenococcus halophilus* that is a HrcA (Accession Nos. dbj|BAB63288.1; AB070346), about 94% identity from amino acids 183-349 with a protein from *Lactobacillus acidophilus* that is a repressor protein HrcA (Accession Nos. gb|AAK97219.1; AF300646), about 39% identity from amino acids 1-345 with a protein from *Listeria innocua* that is a transcription repressor of class I heat-shock gene HrcA (Accession Nos. NP_470848.1; NC_003212), and 39% identity from amino acids 1-345 with a protein from *Listeria monocytogenes* that is a transcription repressor of class I heat-shock gene HrcA (Accession Nos. NP_465000.1; NC_003210).

A Gapped BlastP sequence alignment showed that SEQ ID NO:86 (121 amino acids) has about 47% identity from amino acids 3-111 with a protein from *Streptococcus pyogenes* that is homologous to a ribosome binding factor A (Accession Nos. NP_607758.1; NC_003485), about 46% identity from amino acids 3-111 with a protein from *Streptococcus pyogenes* that is homologous to a ribosome binding factor A (Accession Nos. NP_269744.1; NC_002737), about 46% identity from amino acids 4-108 with a protein from *Lactococcus lactis* that is a ribosome binding factor A (Accession Nos. emb|CAB40558.1; AJ005118), about 47% identity from amino acids 4-108 with a protein from *Lactococcus lactis* subsp *lactis* that is a ribosome-binding factor A (Accession Nos. NP_266924.1; NC_002662), and 43% identity from amino acids 3-115 with a protein from *Streptococcus agalactiae* that is a ribosome binding factor A (Accession Nos. emb|CACO0494.1; AJ251497).

A Gapped BlastP sequence alignment showed that SEQ ID NO:88 (883 amino acids) has about 48% identity from amino acids 7-881 with a protein from *Streptococcus pneumoniae* that is an initiation factor IF2 (Accession Nos. NP_358075.1; NC_003098), about 53% identity from amino acids 150-883 with a protein from *Listeria monocytogenes* that is homologous to a translation initiation factor IF-2 (Accession Nos. NP_464850.1; NC_003210), about 47% identity from amino acids 7-881 with a protein from *Streptococcus pneumoniae* that is a translation initiation factor IF-2 (Accession Nos. NP_345072.1; NC_003028), about 51% identity from amino acids 138-883 with a protein from *Listeria innocua* that is homologous to a translation initiation factor IF-2 (Accession Nos. NP_470698.1; NC_003212), and 46% identity from amino acids 7-880 with a protein from *Streptococcus pyogenes* that is homologous to a initiation factor 2 (Accession Nos. NP_607759.1; NC_003485).

A Gapped BlastP sequence alignment showed that SEQ ID NO:90 (103 amino acids) has about 46% identity from amino acids 3-102 with a protein from *Enterococcus faecium* that is homologous to a ribosomal protein in the infB 5'region (Accession No. sp|P55768|YLXQ_ENTFC), about 45% identity from amino acids 3-95 with a protein from *Streptococcus pneumoniae* that is a ribosomal protein in the L7A family (Accession Nos. NP_345071.1; NC_003028), about 45% identity from amino acids 3-95 with a conserved hypothetical protein from *Streptococcus pneumoniae* (Accession Nos. NP_358074.1; NC_003098), about 41% identity from amino acids 8-101 with a hypothetical protein from *Staphylococcus aureus* subsp. *aureus* (Accession Nos. NP_371792.1; NC_002758), and 39% identity from amino acids 1-100 with a protein from *Lactococcus lactis* subsp. *lactis* that is homologous to a ribosomal protein (Accession Nos. NP_266922.1; NC_002662).

A Gapped BlastP sequence alignment showed that SEQ ID NO:92 (406 amino acids) has about 54% identity from amino acids 18-401 with a protein from *Bacillus halodurans* that is a transcriptional terminator (Accession Nos. NP_243282.1; NC_002570), about 58% identity from amino acids 18-361 with a protein from *Bacillus subtilis* that is a nusA protein (Accession Nos. NP_389542.1; NC_000964), about 56% identity from amino acids 18-360 with a protein from *Listeria monocytogenes* that is homologous to an N utilization substance protein A (Accession Nos. NP_464847.1; NC_003210), about 58% identity from amino acids 18-361 with a protein from *Bacillus subtilis* that is a transcription termination-antitermination factor nusA (Accession No. pir||C36905), and 56% identity from amino acids 18-360 with a protein from *Listeria innocua* that is homologous to an N utilization substance protein A (NusA protein) (Accession Nos. NP_470695.1; NC_003212).

A Gapped BlastP sequence alignment showed that SEQ ID NO:94 (172 amino acids) has about 46% identity from amino acids 15-171 with a conserved hypothetical protein from *Streptococcus pneumoniae* (Accession Nos. NP_345068.1; NC_003028), about 46% identity from amino acids 15-171 with a conserved hypothetical protein from *Streptococcus pheumoniae* (Accession Nos. NP_358071.1; NC_003098), about 43% identity from amino acids 15-172 with a conserved hypothetical protein from *Listeria innocua* (Accession Nos. NP_470694.1; NC_003212), about 43% identity from amino acids 15-172 with a conserved hypothetical protein from *Listeria monocytogenes* (Accession Nos. NP_464846.1; NC_003210), and 40% identity from amino acids 17-172 with a 17.6 kDa protein in NUSA 5'region (P15A) from *Bacillus subtilis* (Accession No. sp|P32726|YLXS_BACSU).

A Gapped BlastP sequence alignment showed that SEQ ID NO:96 (1437 amino acids) has about 48% identity from amino acids 8-1437 with a protein from *Staphylococcus aureus* that is a DNA polymerase III (Accession No. sp|Q53665|DPO3), about 48% identity from amino acids 8-1437 with a protein from *Staphylococcus aureus* subsp. *aureus* that is a DNA polymerase III alpha chain PolC-type (Accession Nos. NP_371788.1; NC_002758), about 50% identity from amino acids 8-1437 with a protein from *Bacillus subtilis* that is a DNA-directed DNA polymerase (EC 2.7.7.7) III alpha chain (version 2) (Accession No. pir||A33920), about 47% identity from amino acids 8-1437 with a protein from *Staphylococcus aureus* that is a DNA polymerase III (Accession Nos. dbj|BAA13160.1; D86727), and 50% identity from amino acids 8-1437 with a protein from *Bacillus subtilis* that is a polymerase III (Accession Nos. gb|AAA22666.1; M22996).

A Gapped BlastP sequence alignment showed that SEQ ID NO:98 (565 amino acids) has about 51% identity from amino acids 1-563 with a protein from *Bacillus subtilis* that is a prolyl-tRNA synthetase (Accession Nos. NP_389539.1; NC_000964), about 49% identity from amino acids 1-564 with a protein from *Bacillus halodurans* that is a prolyl-tRNA synthetase (Accession Nos. NP_243285.1; NC_002570), about 49% identity from amino acids 1-556 with a protein from *Staphylococcus aureus* subsp. *aureus* that is a proline-tRNA ligase (Accession Nos. NP_371787.1; NC_002758), about 49% identity from amino acids 1-556 with a protein from *Listeria* innocua that is a prolyl-tRNA synthetase (Accession Nos. NP_470692.1; NC_003212), and 49% identity from amino acids 1-556 with a protein from *Listeria monocytogenes* that is a prolyl-tRNA synthetase (Accession Nos. _ 464844.1; NC_003210).

A Gapped BlastP sequence alignment showed that SEQ ID NO:100 (279 amino acids) has about 40% identity from amino acids 5-277 with a protein from *Enterococcus faecalis* that is an Eep (Accession Nos. gb|AAD47948.1; AF152237), about 42% identity from amino acids 5-278 with a hypothetical protein from *Lactococcus lactis* subsp. *lactis* (Accession Nos. NP_268285.1; NC 002662), about 39% identity from amino acids 12-277 with a protein from *Listeria innocua* that is homologous to a YluC protein (Accession Nos. NP_470691.1; NC_003212), about 39% identity from amino acids 12-277 with a protein from *Listeria monocytogenes* that is homologous to a YluC protein (Accession Nos. NP_464843.1; NC_003210), and 39% identity from amino acids 5-277 with a protein from *Streptococcus pyogenes* that may be involved in production of a peptide sex pheromone (Accession Nos. NP_269935.1; NC_002737).

A Gapped BlastP sequence alignment showed that SEQ ID NO:102 (150 amino acids) has about 50% identity from amino acids 1-148 with a protein from *Enterococcus faecalis* that is an Eep (Accession Nos. gb|AAD47948.1; AF152237), about 47% identity from amino acids 4-146 with a protein from *Listeria monocytogenes* that is homologous to a YluC protein (Accession Nos. NP_464843.1; NC_003210), about 52% identity from amino acids 3-146 with a protein from *Streptococcus pneumoniae* that is an eep protein (Accession Nos. NP_344801.1; NC_003028), about 52% identity from amino acids 3-146 with a protein from *Streptococcus pneumoniae* that is a determinant for enhanced expression of pheromone (Accession Nos. NP_357836.1; NC_003098), and 47% identity from amino acids 4-146 with a protein from *Listeria innocua* that is homologous to a YluC protein (Accession Nos. NP_470691.1; NC_003212).

A Gapped BlastP sequence alignment showed that SEQ ID NO: 104 (271 amino acids) has about 50% identity from amino acids 1-263 with a protein from *Listeria monocytogenes* that is similar to a phosphatidate cytidylyltransferase (CDP-diglyceride synthase) (Accession Nos. NP_464841.1; NC_003210), about 49% identity from amino acids 1-263 with a protein from *Listeria innocua* that is similar to a phosphatidate cytidylyltransferase (Accession Nos. NP_470689.1; NC_003212), about 47% identity from amino acids 1-263 with a protein from *Bacillus halodurans* that is a phosphatidate cytidylyltransferase (Accession Nos. NP_243288.1; NC_002570), 45% identity from amino acids 1-269 with a protein from *Bacillus subtilis* that is a phosphatidate cytidylyltransferase (CDP-diglyceride synthase)(Accession Nos. NP_389536.1; NC_000964), and 40% identity from amino acids 1-263 with a protein from *Streptococcus pyogenes* that is homologous to a phosphatidate cytidylyltransferase (Accession Nos. NP_269936.1; NC_002737).

A Gapped BlastP sequence alignment showed that SEQ ID NO:106 (219 amino acids) has about 34% identity from amino acids 26-213 with a protein from *Pyrococcus furiosus* that is a DNA polymerase, bacteriophage-type (Accession Nos. NP_579114.1; NC_003413), about 35% identity from amino acids 26-214 with a protein from *Aquifex aeolicus* that is an N-terminus of phage SPO1 DNA polymerase (Accession Nos. NP_214164.1; NC_000918), about 32% identity from amino acids 1-213 with a protein from *Clostridium acetobutylicum* that is a uracyl DNA glycosylase (Accession Nos. NP_346860.1; NC_003030), 34% identity from amino acids 26-208 with a protein from *Sulfolobus tokodaii* that is a homologous to a DNA-directed DNA polymerase (Accession Nos. NP_378238.1; NC_003106), and 33% identity from amino acids 26-213 with a hypothetical protein from *Pyrococcus abyssi* (Accession Nos. NP_126375.1; NC_000868).

A Gapped BlastP sequence alignment showed that SEQ ID NO:108 (310 amino acids) has, about 55% identity from amino acids 4-309 with a protein from *Streptococcus pneumoniae* that is a glycosyl transferase (Accession Nos. NP_359052.1; NC_003098), about 55% identity from amino acids 4-309 with a protein from *Streptococcus pneumoniae* that is an N glycosyl transferase, family 2 (Accession Nos. NP_346050.1; NC_003028), about 51% identity from amino acids 1-309 with a protein from *Streptococcus pyogenes* that is a putative sugar transferase (Accession Nos. NP_606763.1; NC_003485), 51% identity from amino acids 1-309 with a protein from *Streptococcus pyogenes* that is a putative sugar transferase (Accession Nos. NP_268788.1; NC_002737), and 50% identity from amino acids 1-308 with a protein from *Lactococcus lactis* subsp. *lactis* that is a glycosyl transferase (Accession Nos. NP_266263.1; NC_002662).

A Gapped BlastP sequence alignment showed that SEQ ID NO:112 (142 amino acids) has about 26% identity from amino acids 10-132 with a protein from *Bacillus subtilis* that is a yngA (Accession Nos. NP_389699.1; NC_000964), about 25% identity from amino acids 16-132 with a protein from *Pyrococcus abyssi* that is a dolichol-phosphate mannosyltransferase (Accession Nos. NP_125751.1; NC_000868), about 21% identity from amino acids 16-132 with a protein from *Pyrococcus furiosus* that is a sugar transferase dolichol monophosphate mannose synthase (Accession Nos. NP_577787.1; NC_003413), 25% identity from amino acids 1-134 with a protein from *Clostridium acetobutylicum* that is a homolog of YNGA/YWCD (Accession Nos. NP_347648.1; NC_003030), and 28% identity from amino acids 17-133 with a protein from *Mycobacterium leprae* that is a possible membrane protein (Accession Nos. NP_301207.1; NC_002677).

A Gapped BlastP sequence alignment showed that SEQ ID NO:114 (144 amino acids) has about 69% identity from amino acids 30-144 with a protein from *Streptococcus pyogenes* that is a 50S ribosomal protein L19 (Accession Nos. NP_268954.1; NC_002737), about 68% identity from amino acids 30-144 with a protein from *Streptococcus thermophilus* that is a 50S ribosomal protein L19 (Accession No. sp|O3403 |RL19_STRTR), about 68% identity from amino acids 30-144 with a protein from *Bacillus subtilis* that is a ribosomal protein L19 (Accession Nos. NP_389486.1; NC_000964), 68% identity from amino acids 30-144 with a protein from *Bacillus subtilis* that is a 50S ribosomal protein L19 (Accession No. sp|O31742|RL19_BACSU), and 67% identity from amino acids 30-144 with a protein from *Streptococcus pneumoniae* that is a ribosomal protein L19 (Accession Nos. NP_345757.1; NC_003028).

A Gapped BlastP sequence alignment showed that SEQ ID NO:116 (242 amino acids) has about 47% identity from amino acids 1-236 with a protein from *Streptococcus pneumoniae* that is a tRNA (guanine-N1)-methyltransferase (Accession Nos. NP_358281.1; NC_003098), about 47% identity from amino acids 1-236 with a protein from *Streptococcus pneumoniae* that is a tRNA (guanine-N1)-methyltransferase (Accession Nos. NP_345277.1; NC_003028), about 45% identity from amino acids 1-238 with a protein from *Bacillus subtilis* that is a tRNA methyltransferase (Accession Nos. NP_389485.1; NC_000964), 45% identity from amino acids 1-233 with a protein from *Clostridium perfringens* that is a tRNA (guanine-N1)-methyltransferase (Accession Nos. NP_562625.1; NC_003366), and 48% identity from amino acids 1-241 with a protein from *Streptococcus pyogenes* that is homologous to a tRNA (guanine-N1)-methyltransferase (Accession Nos. NP_269056.1; NC_002737).

A Gapped BlastP sequence alignment showed that SEQ ID NO:118 (194 amino acids) has about 39% identity from amino acids 24-194 with a protein from *Streptococcus pyogenes* that is homologous to a 16S rRNA processing protein (Accession Nos. NP_269055.1; NC_002737), about 41% identity from amino acids 27-192 with a protein from *Listeria monocytogenes* that is homologous to a 16S rRNA processing protein RimM (Accession Nos. NP_465318.1; NC_003210), about 41% identity from amino acids 27-192 with a protein from *Listeria innocua* that is homologous to a 16S rRNA processing protein RimM (Accession Nos. NP_471241.1; NC_003212), 39% identity from amino acids 24-194 with a protein from *Streptococcus pyogenes* that is homologous to a 16S rRNA processing protein RimM (Accession Nos. NP_607058.1; NC_003485), and 39% identity from amino acids 24-194 with a protein from *Streptococcus pneumoniae* that is a 16S rRNA processing protein RimM (Accession Nos. NP_358280.1; NC_003098).

A Gapped BlastP sequence alignment showed that SEQ ID NO:120 (90 amino acids) has about 64% identity from amino acids 1-90 with a protein from *Streptococcus pyogenes* that is a 30S ribosomal protein S 16 (Accession Nos. NP_269049.1; NC_002737), about 65% identity from amino acids 1-90 with a protein from *Bacillus subtilis* that is a ribosomal protein S16 (BS17) (Accession Nos. NP_389481.1; NC_000964), about 66% identity from amino acids 1-90 with a protein from *Geobacillus stearothermophilus* that is a 30S ribosomal protein S16 (Accession No. sp|P81290|RS16_BACST), 63% identity from amino acids 1-90 with a protein from *Bacillus halodurans* that is a 30S ribosomal protein S16; ribosomal protein S16 (Accession Nos. NP_243349.1; NC_002570) and 63% identity from amino acids 1-90 with a protein from *Lactococcus lactis* subsp. *lactis* that is a 30S ribosomal protein S16 (Accession Nos. NP_267725.1; NC_002662).

A Gapped BlastP sequence alignment showed that SEQ ID NO:122 (476 amino acids) has about 62% identity from amino acids 1-445 with a protein from *Streptococcus pneumoniae* that is a signal recognition particle protein (Accession Nos. NP_345751.1; NC_003028), about 62% identity from amino acids 1-445 with a protein from *Streptococcus pneumoniae* that is a signal recognition particle (Accession Nos. NP_358759.1; NC_003098), about 62% identity from amino acids 1-435 with a protein from *Streptococcus mutans* that is a signal recognition particle protein (Accession No. sp|Q54431|SR54_STRMU), 59% identity from amino acids 1-445 with a protein from *Streptococcus pyogenes* that is homologous to a signal recognition particle-inhibited division protein (Accession Nos. NP_607268.1; NC_003485) and 59% identity from amino acids 1-445 with a protein from *Streptococcus pyogenes* that is homologous to a signal recognition particle (Accession Nos. NP_269339.1; NC_002737).

A Gapped BlastP sequence alignment showed that SEQ ID NO:124 (116 amino acids) has about 44% identity from amino acids 6-98 with a conserved hypothetical protein from *Streptococcus pneumoniae* (Accession Nos. NP_345752.1;

NC_003028), about 43% identity from amino acids 6-97 with a 13.3 kDa protein from *Streptococcus mutans* (Accession No. sp|P96468|YLXM_STRMU), about 46% identity from amino acids 6-91 with a conserved hypothetical protein from *Streptococcus pneumoniae* (Accession Nos. NP_358760.1; NC_003098), 51% identity from amino acids 6-79 with a protein from *Streptococcus pyogenes* that is homologous to a DNA-binding protein (Accession Nos. NP_269340.1; NC_002737) and 52% identity from amino acids 6-76 with a hypothetical protein from *Bacillus subtilis* (Accession Nos. gb|AAC44501.1; U48884).

A Gapped BlastP sequence alignment showed that SEQ ID NO:126 (488 amino acids) has about 69% identity from amino acids 15-486 with a hypothetical protein from *Staphylococcus aureus* subsp. *aureus* (Accession Nos. NP_373127.1; NC_002758), about 62% identity from amino acids 22-488 with a protein from *Lactococcus lactis* subsp. *lactis* that is a cationic amino acid transporter (Accession Nos. NP_266267.1; NC_002662), about 41% identity from amino acids 31-487 with a protein from *Listeria monocytogenes* that is homologous to an amino acid transporter (Accession Nos. NP_464172.1; NC_003210), 40% identity from amino acids 31-487 with a protein from *Listeria innocua* that is homologous to an amino acid transporter (Accession Nos. NP_469991.1; NC_003212) and 38% identity from amino acids 35-487 with a protein from *Listeria monocytogenes* that is homologous to an amino acid transporter (Accession Nos. NP_465992.1; NC_003210).

A Gapped BlastP sequence alignment showed that SEQ ID NO:128 (135 amino acids) has about 20% identity from amino acids 12-126 with a protein from *Clostridium perfringens* that is a clpB protein (Accession Nos. NP_562344.1; NC_003366), about 30% identity from amino acids 30-82 with a hypothetical protein from *Homo sapiens* that is a MGC3079 protein (Accession Nos. XP_056208.1; XM_056208), about 30% identity from amino acids 30-82 with a hypothetical protein from *Homo sapiens* (Accession No. pir||T02245), 21% identity from amino acids 6-130 with a protein from *Clostridium acetobutylicum* that is a transcriptional regulator in the MarR/EmrR family (Accession Nos. NP_350003.1; NC_003030) and 25% identity from amino acids 26-124 with a hypothetical protein from *Arabidopsis thaliana* (Accession Nos. gb|AAG13070.1; AC023754).

A Gapped BlastP sequence alignment showed that SEQ ID NO:130 (487 amino acids) has about 50% identity from amino acids 17-487 with a protein from *Lactobacillus sakei* that is homologous to a dipeptidase (Accession No. sp|Q48841|PEPD_LACSK), about 41% identity from amino acids 20-485 with a protein from *Lactococcus lactis* subsp. *lactis* that is a dipeptidase (Accession Nos. NP_267714.1; NC_002662), about 42% identity from amino acids 21-483 with a protein from *Lactobacillus helveticus* that is a dipeptidase (Accession Nos. emb|CAA86210.1; Z38063), 42% identity from amino acids 21-483 with a protein from *Lactobacillus helveticus* that is a dipeptidase A (Accession No. sp|Q48558|PEDA_LACHE) and 38% identity from amino acids 20-485 with a protein from *Streptococcus pyogenes* that is homologous to a dipeptidase (Accession Nos. NP_606948.1; NC_003485).

A Gapped BlastP sequence alignment showed that SEQ ID NO:132 (431 amino acids) has about 54% identity from amino acids 1-431 with a protein from *Streptococcus pneumoniae* that is a cell division protein FtsY (Accession Nos. NP_358716.1; NC_003098), about 54% identity from amino acids 1-431 with a protein from *Streptococcus pneumoniae* that is a signal recognition particle-docking protein FtsY (Accession Nos. NP_345709.1; NC_003028), about 51% identity from amino acids 14-431 with a protein from *Streptococcus pyogenes* that is homologous to a signal recognition particle (docking protein) (Accession Nos. NP_268833.1; NC_002737), 50% identity from amino acids 14-431 with a protein from *Streptococcus pyogenes* that is homologous to a signal recognition particle (docking protein) (Accession Nos. NP_606823.1; NC_003485) and 51% identity from amino acids 9-431 with a protein from *Streptococcus agalactiae* that is homologous to a signal recognition particle (Accession Nos. gb|AAL26980.1; AF380672).

A Gapped BlastP sequence alignment showed that SEQ ID NO:134 (1189 amino acids) has about 35% identity from amino acids 3-1181 with a protein from *Listeria innocua* that is homologous to an Smc protein essential for chromosome condensation and partition (Accession Nos. NP_471252.1; NC_003212), about 35% identity from amino acids 3-1184 with a protein from *Bacillus halodurans* that is a chromosome segregation SMC protein (Accession Nos. NP_243353.1; NC_002570), about 35% identity from amino acids 3-1181 with a protein from *Listeria moliocytogenes* that is homologous to a Smc protein essential for chromosome condensation and partition (Accession Nos. NP_465329.1; NC_003210), 36% identity from amino acids 3-1184 with a protein from *Bacillus subtilis* that is homologous to a chromosome segregation SMC protein (Accession Nos. NP_389476.1; NC_000964) and 35% identity from amino acids 3-1184 with a protein from *Bacillus subtilis* that is a minichromosome stabilizing protein SMC (Accession No. pir||JC4819).

A Gapped BlastP sequence alignment showed that SEQ ID NO:136 (228 amino acids) has about 53% identity from amino acids 10-226 with a protein from *Streptococcus pneumoniae* that is a ribonuclease III (Accession Nos. NP_345713.1; NC_003028), about 53% identity from amino acids 10-226 with a protein from *Streptococcus pneumoniae* that is a ribonuclease III (Accession Nos. NP_358720.1; NC_003098), about 51% identity from amino acids 10-224 with a protein from *Streptococcus pyogenes* that is homologous to a ribonuclease III (Accession Nos. NP_268805.1; NC_002737), 47% identity from amino acids 5-225 with a protein from *Lactococcus lactis* that is a ribonuclease III (EC 3.1.26.3) (Accession Nos. NP_266958.1; NC_002662) and 47% identity from amino acids 9-226 with a protein from *Listeria monocytogenes* that is homologous to a ribonuclease III (Accession Nos. NP_465330.1; NC_003210).

A Gapped BlastP sequence alignment showed that SEQ ID NO:138 (120 amino acids) has about 62% identity from amino acids 1-120 with a protein from *Streptococcus pyogenes* that is homologous to an alkaline-shock protein (Accession Nos. NP_269877.1; NC_002737), about 60% identity from amino acids 1-120 with a conserved hypothetical protein from *Streptococcus pneumoniae* (Accession Nos. NP_344963.1; NC_003028), about 54% identity from amino acids 1-120 with a protein from *Listeria innocua* (Accession Nos. NP_471263.1; NC_003212), 59% identity from amino acids 1-120 with a protein from *Streptococcus pneumoniae* that is an alkaline shock protein (Accession Nos. NP_357993.1; NC_003098) and 51% identity from amino acids 1-117 with a conserved protein from *Bacillus halodurans* (Accession Nos. NP_243365.1; NC_002570).

A Gapped BlastP sequence alignment showed that SEQ ID NO:140 (145 amino acids) has about 66% identity from amino acids 3-145 with a protein from *Listeria innocua* that is homologous to a transcriptional regulator (PilB family) (Accession Nos. NP_471307.1; NC_003212), about 64% identity from amino acids 3-145 with a protein from *Listeria monocytogenes* that is a transcriptional regulator (PilB family) (Accession Nos. NP_465384.1; NC_003210), about 68% identity from amino acids 20-144 with a protein from *Streptococcus pyogenes* that is homologous to a heavy metal stress response protein (Accession Nos. NP_269221.1; NC_002737), 60% identity from amino acids 2-145 with a protein from *Fusobacterium nucleatum* subsp. *nucleatum* that is a cytochrome C-type biogenesis protein ccdA (Accession Nos. NP_603700.1; NC_003454) and 62% identity from amino acids 5-145 with a conserved hypothetical protein from *Mycoplasma pneumoniae* (Accession Nos. NP_110351.1; NC_000912).

A Gapped BlastP sequence alignment showed that SEQ ID NO:142 (454 amino acids) has about 48% identity from amino acids 5-449 with a protein from *Enterococcus faecalis* that is an NADH peroxidase (EC 1.11.1.1) (Accession No. sp|P37062|NAPE_ENTFA), about 48% identity from amino acids 5-449 with a protein from *Enterococcus faecalis* that is a Nadh Peroxidase (Npx) (E.C. 1.11.1.1) mutant with Leu 40 replaced by Cys (L40C) (Accession No. pdb|1NHR|), about 48% identity from amino acids 5-449 with a protein from *Enterococcus faecalis* that is a NADH peroxidase (Npx) (E.C.1.11.1.1) mutant with Ser 41 replaced by Cys (S41C) (Accession No. pdb|1NHS|), 48% identity from amino acids 5-449 with a protein from *Enterococcus faecalis* that is a chain A, crystal structure of NADH peroxidase mutant: R303m (Accession No. pdb|1F8W|A) and 48% identity from amino acids 5-449 with a protein from *Enterococcus faecalis* that is an NADH peroxidase with cysteine-sulfenic acid (Accession No. pdb|1JOA|).

A Gapped BlastP sequence alignment showed that SEQ ID NO:144 (108 amino acids) has about 40% identity from amino acids 43-108 with a protein from *Listeria monocytogenes* that is a low temperature requirement protein A (Accession Nos. NP_463919.1; NC_003210), about 38% identity from amino acids 43-108 with a protein from *Listeria innocua* that is a low temperature requirement protein A (Accession Nos. NP_469752.1; NC_003212), about 38% identity from amino acids 43-108 with a protein from *Listeria monocytogenes* that is a low temperature requirement A protein (Accession Nos. gb|AAC98899.1; AF023180), and 61% identity from amino acids 29-54 with a protein from *Methanococcus jannaschii* that is a cobalamin (5'-phosphate) synthase (cobS) (Accession Nos. NP_248442.1; NC_000909).

A Gapped BlastP sequence alignment showed that SEQ ID NO:146 (525 amino acids) has about 36% identity from amino acids 16-505 with a protein from *Listeria innocua* that is a two-component sensor histidine kinase (Accession Nos. NP_470751.1; NC_003212), about 36% identity from amino acids 16-505 with a protein from *Listeria monocytogenes* that is a two-component sensor histidine kinase (Accession Nos. NP_464903.1; NC_003210), about 32% identity from amino acids 6-502 with a protein from *Lactococcus lactis* subsp. *lactis* that is a sensor protein kinase (Accession Nos. NP_267749.1; NC_002662), 31% identity from amino acids 6-502 with a protein from *Lactococcus lactis* subsp. *cremoris* that is homologous to a histidine protein kinase (Accession Nos. gb|AAC45383.1; U81166), and 32% identity from amino acids 5-507 with a protein from *Streptococcus pyogenes* that is a transmembrane histidine kinase CsrS (Accession Nos. gb|AAF00082.2; AF095713).

A Gapped BlastP sequence alignment showed that SEQ ID NO:148 (238 amino acids) has about 69% identity from amino acids 1-231 with a protein from *Listeria innocua* that is a two-component response regulator (Accession Nos. NP_470750.1; NC_003212), about 61% identity from amino acids 3-232 with a protein from *Lactococcus lactis* subsp. *lactis* that is a two-component system regulator (Accession Nos. NP_267750.1; NC_002662), about 61% identity from amino acids 3-232 with a protein from *Lactococcus lactis* subsp. *cremoris* that is homologous to a response regulator Rra (Accession Nos. gb|AAF73970.1; U81166), 61% identity from amino acids 3-233 with a protein from *Streptococcus pyogenes* that is a CsrR (Accession Nos. gb|AAC64935.1; AF082668), and 61% identity from amino acids 3-233 with a protein from *Streptococcus pyogenes* that is a CovR (Accession Nos. NP_606584.1; NC_003485).

A Gapped BlastP sequence alignment showed that SEQ ID NO:150 (697 amino acids) has about 28% identity from amino acids 380-525 with a protein from *Mus musculus* that is a PX domain containing protein (Accession Nos. dbj|BAB30596.1; AK017102), about 24% identity from amino acids 437-638 with a protein from *Streptomyces coelicolor* that is homologous to an integral membrane protein (Accession Nos. emb|CAC01334.1; AL390968), about 24% identity from amino acids 466-583 with a protein from *Sulfolobus solfataricus* that is a dihydrolipoamide dehydrogenase (pdhD-1) (Accession Nos. NP_342588.1; NC_002754), 41% identity from amino acids 392-436 with a protein from *Arabidopsis thaliana* that is homologous to a cytochrome P450 (Accession Nos. NP_188079.1; NM_112322), and 34% identity from amino acids 51-100 with a protein from *Bacillus subtilis* that is a histidinol-phosphatase (HolPase) (Accession No. sp|03441|HIS9_BACSU).

A Gapped BlastP sequence alignment showed that SEQ ID NO:152 (438 amino acids) has about 27% identity from amino acids 86-216 with a protein from *Brochothrix campestris* that is a transport accessory protein (Accession Nos. gb|AAC95141.1; AF075600), about 26% identity from amino acids 107-219 with a protein from *Streptococcus pneumoniae* that is a bacterocin transport accessory protein (Accession Nos. NP_345950.1; NC_003028), about 26% identity from amino acids 107-219 with a protein from *Streptococcus pneumoniae* that is a Bta (Accession Nos. gb|AAD56628.1; AF165218), 23% identity from amino acids 88-201 with a hypothetical protein from *Bacillus anthracis* (Accession Nos. NP_052783.1; NC_001496), and 32% identity from amino acids 144-214 with a protein from *Neisseria meningitidis* that is a thioredoxin (Accession Nos. NP_274384.1; NC_003112).

A Gapped BlastP sequence alignment showed that SEQ ID NO:154 (217 amino acids) has about 55% identity from amino acids 13-321 with a protein from *Listeria monocytogenes* that is a thioredoxin reductase (EGD-e) (Accession Nos. NP_466001.1; NC_003210), about 54% identity from amino acids 9-320 with a protein from *Bacillus halodurans* that is a thioredoxin reductase (NADPH) (Accession Nos. NP_244438.1; NC_002570), about 56% identity from amino acids 15-316 with a protein from *Streptococcus pyogenes* that is a thioredoxin reductase (Accession Nos. NP_607711.1; NC_003485), 56% identity from amino acids 13-315 with a protein from *Listeria innocua* that is a thioredoxin reductase (Accession Nos. NP_471951.1; NC_003212), and 53% identity from amino acids 13-316 with a protein from *Lactobacillus delbrueckii* that is a TrxB protein (Accession Nos. gb|AAL14787.1; AF320250).

A Gapped BlastP sequence alignment showed that SEQ ID NO:156 (103 amino acids) has about 31% identity from amino acids 22-90 with a protein from *Vibrio cholerae* that is a thioredoxin 2 (Accession Nos. NP_233138.1; NC_002506), about 30% identity from amino acids 17-82 with a protein from *Clostridium sticklandii* that is a thioredoxin (Accession Nos. emb|CAC14298.1; AJ276209), about 26% identity from amino acids 22-96 with a protein from *Staphylococcus warneri* that is a thioredoxin (Accession Nos.

dbj|BAA99391.1; AB034941), 33% identity from amino acids 14-81 with a hypothetical protein from *Pyrococcus furiosus* (Accession Nos. NP_578470.1; NC_003413), and 25% identity from amino acids 22-89 with a protein from *Arabidopsis thaliana* that is a thioredoxin-like protein (Accession Nos. NP_177802.1; NM 106326).

A Gapped BlastP sequence alignment showed that SEQ ID NO:158 (709 amino acids) has about 50% identity from amino acids 43-675 with a protein from *Listeria innocua* that is an ATP-dependent protease (Accession Nos. NP_470333.1; NC_003212), about 48% identity from amino acids 20-669 with a protein from *Lactococcus lactis* that is an ATP-dependent clp protease ATP-binding subunit clpE (Accession No. sp|Q9S5Z2|CLPE_LACLC), about 47% identity from amino acids 20-684 with a protein from *Lactococcus lactis* subsp. *lactis* that is an ATP-dependent protease ATP-binding subunit (Accession Nos. NP_266713.1; NC_002662), 51% identity from amino acids 66-675 with a protein from *Listeria monocytogenes* that is an ATP-dependent protease (EGD-e) (Accession Nos. NP_464522.1; NC_003210), and 46% identity from amino acids 8-669 with a protein from *Streptococcus pyogenes* that is homologous to an ATP-dependent protease (Accession Nos. NP_607597.1; NC_003485).

A Gapped BlastP sequence alignment showed that SEQ ID NO:160 (343 amino acids) has about 69% identity from amino acids 1-342 with a protein from *Lactobacillus delbrueckii* that is a ygaP protein (Accession No. pir||T09632), about 43% identity from amino acids 1-342 with a protein from *Listeria monocytogenes* that is homologous to a transcriptional regulator (CggR) (Accession Nos. NP_465983.1; NC_003210), about 43% identity from amino acids 1-342 with a protein from *Listeria innocua* that is homologous to a transcriptional regulator (CggR) (Accession Nos. NP_471884.1; NC_003212), 39% identity from amino acids 1-340 with a protein from *Bacillus halodurans* that is a transcriptional regulator (Accession Nos. NP_244428.1; NC_002570), and 40% identity from amino acids 11-341 with a protein from *Bacillus subtilis* that is a yvbQ protein (Accession Nos. NP_391275.1; NC_000964).

A Gapped BlastP sequence alignment showed that SEQ ID NO:162 (433 amino acids) has about 63% identity from amino acids 11-427 with a protein from *Lactococcus lactis* subsp. *lactis* that is a 2-phosphoglycerate dehydratase (EC 4.2.1.11) (Accession Nos. NP_266432.1; NC_002662), about 61% identity from amino acids 11-427 with a protein from *Streptococcus thermophilus* that is an enolase (2-phosphoglycerate dehydratase) (2-phospho-D-glycerate hydrolyase) (Accession No. sp|O52191|ENO_STRTR), about 56% identity from amino acids 9-420 with a protein from *Aquifex aeolicus* that is an enolase (Accession Nos. NP_213338.1; NC_000918), 57% identity from amino acids 9-418 with a protein from *Bacillus halodurans* that is an enolase (2-phosphoglycerate dehydratase) (Accession Nos. NP_244423.1; NC_002570), and 55% identity from amino acids 11-419 with a protein from *Thermotoga maritima* that is an enolase (2-phosphoglycerate dehydratase) (2-phospho-D-glycerate hydrolyase) (Accession No. sp|P42848|ENO_THEMA).

A Gapped BlastP sequence alignment showed that SEQ ID NO:164 (405 amino acids) has about 76% identity from amino acids 13-405 with a protein from *Geobacillus stearothermophilus* that is an elongation factor Tu (EF-Tu) (Accession No. sp|O50306|EFTU_BACST), about 75% identity from amino acids 13-403 with a protein from *Lactococcus lactis* subsp. *lactis* that is an elongation factor Tu (Accession No. NP_268018.1; NC_002662), about 72% identity from amino acids 13-405 with a protein from *Taxeobacter ocellatus* that is an elongation factor Tu (EF-Tu) (Accession No. sp|P42480|EFTU_TAXOC), 69% identity from amino acids 13-405 with a protein from *Porphyromonas gingivalis* that is an EF-Tu (Accession Nos. dbj|BAA88135.1; AB035462), and 69% identity from amino acids 13-405 with a protein from *Bacteroides forsythus* that is an EF-Tu (Accession Nos. dbj|BAA88139.1; AB035466).

A Gapped BlastP sequence alignment showed that SEQ ID NO:166 (296 amino acids) has about 48% identity from amino acids 2-278 with a conserved hypothetical protein from *Streptococcus pneumoniae* (Accession Nos. NP_358441.1; NC_003098), about 48% identity from amino acids 2-278 with a conserved hypothetical protein from *Streptococcus pneumoniae* (Accession Nos. NP_345429.1; NC_003028), about 43% identity from amino acids 15-294 with a protein from *Listeria monocytogenes* that is homologous to a YitL protein from *B. subtilis* (Accession Nos. NP_464544.1; NC_003210), 43% identity from amino acids 15-294 with a protein from *Listeria innocua* that is homologous to a YitL protein from *B. subtilis* (Accession Nos. NP_470355.1; NC_003212), and 42% identity from amino acids 1-277 with a conserved hypothetical protein from *Streptococcus pyogenes* (Accession Nos. NP_268757.1; NC_002737).

A Gapped BlastP sequence alignment showed that SEQ ID NO:168 (479 amino acids) has about 97% identity from amino acids 1-479 with a protein from *Lactobacillus acidophilus* that is an F1F0-ATPase subunit beta (Accession Nos. gb|AAF22498.1; AF098522), about 81% identity from amino acids 2-468 with a protein from *Lactobacillus casei* that is an ATP synthase beta chain (Accession No. sp|Q03234|ATPB_LACCA), about 80% identity from amino acids 1-465 with a protein from *Enterococcus faecalis* that is an ATP synthase beta chain (Accession No. sp|P43451|ATPB_ENTHR), 79% identity from amino acids 1-466 with a protein from *Streptococcus mutans* that is an ATP synthase beta chain (Accession No. sp|P95789|ATPB_STRMU), and 78% identity from amino acids 1-465 with a protein from *Streptococcus pneumoniae* that is an ATP synthase F1, beta subunit (Accession Nos. NP_345959.1; NC_003028).

A Gapped BlastP sequence alignment showed that SEQ ID NO:170 (444 amino acids) has about 100% identity from amino acids 1-444 with a protein from *Lactobacillus acidophilus* that is an S-layer protein precursor (Accession No. sp|P35829|SLAP_LACAC), about 73% identity from amino acids 1-443 with a protein from *Lactobacillus helveticus* that is a surface layer protein (Accession Nos. emb|CAB46985.1; AJ388559), about 73% identity from amino acids 1-443 with a protein from *Lactobacillus helveticus* that is a surface layer protein (Accession Nos. emb|CAB46984.1; AJ388558), 73% identity from amino acids 1-443 with a protein from *Lactobacillus helveticus* that is a surface layer protein (Accession Nos. emb|CAB46986.1; AJ388560), and 73% identity from amino acids 1-443 with a protein from *Lactobacillus helveticus* that is a surface layer protein (Accession Nos. emb|CAB46989.1; AJ388563).

A Gapped BlastP sequence alignment showed that SEQ ID NO:172 (805 amino acids) has about 65% identity from amino acids 7-805 with a protein from *Lactobacillus pentosus* that is a phosphoketolase (Accession Nos. emb|CAC84393.1; AJ309011), about 56% identity from amino acids 15-801 with a protein from *Clostridium acetobutylicum* that is a transketolase (Accession Nos. NP_347971.1; NC_003030), about 52% identity from amino acids 11-805 with a protein from *Lactococcus lactis* subsp. *lactis* that is a phosphoketolase (Accession Nos.

NP_267658.1; NC_002662), 49% identity from amino acids 17-801 with a protein from *Brucella melitensis* that is a transketolase (Accession Nos. NP_541859.1; NC_003318), and 49% identity from amino acids 17-801 with a hypothetical protein from *Nostoc* sp. PCC 7120 (Accession Nos. NP_486607.1; NC_003272).

A Gapped BlastP sequence alignment showed that SEQ ID NO:174 (330 amino acids) has about 63% identity from amino acids 1-330 with a protein from *Lactobacillus casei* that is a UDP-glucose 4-epimerase (galactowaldenase) (UDP-galactose 4-epimerase) (Accession No. sp|O84903|GALE_LACCA), about 62% identity from amino acids 1-330 with a protein from *Streptococcus salivarius* that is a UDP-glucose 4-epimerase (Accession Nos. gb|AAL67291.1; AF389474), about 62% identity from amino acids 1-330 with a protein from *Streptococcus thermophilus* that is a UDP-glucose 4-epimerase (Accession Nos. gb|AAL67298.1; AF389475), 60% identity from amino acids 1-330 with a protein from *Streptococcus mutans* that is a UDP-glucose 4-epimerase (galactowaldenase) (UDP-galactose 4-epimerase) (Accession No. sp|P96995|GALE_STRMU), and 57% identity from amino acids 1-329 with a protein from *Staphylococcus carnosus* that is a GalE protein (Accession Nos. gb|AAF25549.1; AF109295).

A Gapped BlastP sequence alignment showed that SEQ ID NO:176 (506 amino acids) has about 99% identity from amino acids 4-506 with a protein from *Lactobacillus acidophilus* that is an F1F0-ATPase subunit alpha (Accession Nos. gb|AAF22496.1; AF098522), about 78% identity from amino acids 4-501 with a protein from *Enterococcus faecalis* that is an ATP synthase alpha chain (Accession No. sp|P26679|ATPA_ENTHR), about 76% identity from amino acids 4-506 with a protein from *Listeria monocytogenes* that is homologous to an H+-transporting ATP synthase chain (Accession Nos. NP_466054.1; NC_003210), 75% identity from amino acids 4-506 with a protein from *Listeria innocua* that is homologous to a H+-transporting ATP synthase chain alpha (Accession Nos. NP_472004.1; NC_003212), and 76% identity from amino acids 4-499 with a protein from *Streptococcus bovis* that is a proton-translocating ATPase, alpha subunit (Accession Nos. dbj|BAA23753.1; AB009314).

A Gapped BlastP sequence alignment showed that SEQ ID NO:178 (237 amino acids) has about 97% identity from amino acids 1-237 with a protein from *Lactobacillus acidophilus* that is an F1F0-ATPase subunit alpha (Accession Nos. gb|AAF22492.1; AF098522), about 46% identity from amino acids 2-237 with a protein from *Enterococcus faecalis* that is an ATP synthase alpha chain (Accession No. sp|P43454|ATP6_ENTHR), about 42% identity from amino acids 1-237 with a protein from *Streptococcus mutans* that is an ATP synthase alpha chain (Accession No. sp|P95784|ATP6_STRMU), 41% identity from amino acids 1-237 with a protein from *Listeria innocua* that is homologous to a H+-transporting ATP synthase chain alpha (Accession Nos. NP_472008.1; NC_003212), and 40% identity from amino acids 1-237 with a protein from *Listeria monocytogenes* that is homologous to an H+-transporting ATP synthase chain alpha (Accession Nos. NP_466058.1; NC_003210).

A Gapped BlastP sequence alignment showed that SEQ ID NO:180 (95 amino acids) has about 74% identity from amino acids 7-95 with a protein from *Staphylococcus aureus* subsp. *aureus* that is a DNA-binding protein II (Accession Nos. NP_371997.1; NC_002758), about 70% identity from amino acids 7-95 with a protein from *Bacillus stearothermophilus* that is an DNA-binding protein HU (DNA-binding protein II) (HB) (Accession No. sp|P02346|DBH_BACST), about 67% identity from amino acids 7-94 with a synthetic construct that is an HBsu protein (Accession Nos. gb|AAA72912.1; M38482), 70% identity from amino acids 7-95 with a protein from *Bacillus caldolyticus* that is a DNA binding protein HU (Accession No. prf||1702428A), and 67% identity from amino acids 7-94 with a protein from *Bacillus subtilis* that is a non-specific DNA-binding protein HBsu (Accession Nos. NP_390160.1; NC_000964).

A Gapped BlastP sequence alignment showed that SEQ ID NO:182 (445 amino acids) has about 67% identity from amino acids 1-445 with a protein from *Streptococcus pneumoniae* that is a glucose-6-phosphate isomerase (Accession Nos. NP_359473.1; NC_003098), about 67% identity from amino acids 1-445 with a protein from *Streptococcus pneumoniae* that is a glucose-6-phosphate isomerase (Accession Nos. NP_346493.1; NC_003028), about 65% identity from amino acids 1-445 with a protein from *Streptococcus mutans* that is a glucose-6-phosphate isomerase (GPI) (phosphoglucose isomerase) (PGI) (phosphohexose isomerase) (PHI) (Accession No. sp|Q9X670|G6PI_STRMU), 65% identity from amino acids 1-445 with a protein from *Streptococcus thermophilus* that is a glucose-6-phosphate isomerase (Accession Nos. gb|AAL35379.1; AF442553), and 69% identity from amino acids 29-444 with a protein from *Lactobacillus casei* that is homologous to a glucose 6-phosphate isomerase (Accession Nos. dbj|BAA76436.1; AB023773).

A Gapped BlastP sequence alignment showed that SEQ ID NO:184 (577 amino acids) has about 68% identity from amino acids 1-573 with a protein from *Lactobacillus sakei* that is a phosphoenolpyruvate-protein phosphotransferase (phosphotransferase system, enzyme I) (Accession No. sp|O07126|PT1_LACSK), about 68% identity from amino acids 1-568 with a protein from *Lactobacillus casei* that is an enzyme I (Accession Nos. gb|AAF74347.1; AF159589), about 67% identity from amino acids 1-563 with a protein from *Streptococcus thermophilus* that is an enzyme I (Accession Nos. gb|AAL47558.1; AY064171), 67% identity from amino acids 1-563 with a protein from *Streptococcus salivarius* that is a phosphoenolpyruvate:sugar phosphotransferase system enzyme I (Accession No. sp|P30299|PT1_STRSL), and 65% identity from amino acids 1-563 with a protein from *Streptococcus pneumoniae* that is a phosphoenolpyruvate-protein phosphotransferase (Accession Nos. NP_345645.1; NC_003028).

A Gapped BlastP sequence alignment showed that SEQ ID NO:186 (408 amino acids) has about 87% identity from amino acids 6-408 with a protein from *Lactobacillus delbrueckii* that is a phosphoglycerate kinase (Accession No. sp|O32756|PGK_LACDE), about 68% identity from amino acids 6-408 with a protein from *Listeria innocua* that is homologous to a phosphoglycerate kinase (Accession Nos. NP_471882.1; NC_003212), about 68% identity from amino acids 6-408 with a protein from *Listeria monocytogenes* that is homologous to a phosphoglycerate kinase (Accession Nos. NP_465981.1; NC_003210), 64% identity from amino acids 8-408 with a protein from *Fusobacterium nucleatum* subsp. *nucleatum* that is a phosphoglycerate kinase (Accession Nos. NP_603551.1; NC_003454), and 63% identity from amino acids 6-408 with a protein from *Staphylococcus aureus* subsp. *aureus* that is a phosphoglycerate kinase (Accession Nos. NP_371297.1; NC_002758).

A Gapped BlastP sequence alignment showed that SEQ ID NO:188 (395 amino acids) has about 35% identity from amino acids 4-380 with a conserved hypothetical protein from *Streptococcus pyogenes* (Accession Nos.

NP_607135.1; NC_003485), about 35% identity from amino acids 4-380 with a conserved hypothetical protein from *Streptococcus pyogenes* (Accession Nos. NP_269188.1; NC_002737), about 33% identity from amino acids 4-380 with a protein from *Streptococcus pneumoniae* that is a membrane protein (Accession Nos. NP_345956.1; NC_003028), 35% identity from amino acids 10-394 with a conserved hypothetical membrane protein from *Listeria innocua* (Accession Nos. NP_469936.1; NC_003212), and 35% identity from amino acids 10-394 with a conserved hypothetical membrane protein from *Listeria monocytogenes* (Accession Nos. NP_464112.1; NC_003210).

A Gapped BlastP sequence alignment showed that SEQ ID NO:190 (585 amino acids) has about 63% identity from amino acids 1-585 with a protein from *Lactobacillus delbrueckii* subsp. *bulgaricus* that is an oligopeptide binding protein OppA1 (Accession Nos. gb|AAK72116.1; AY040221), about 55% identity from amino acids 10-585 with a protein from *Lactobacillus delbrueckii* subsp. *bulgaricus* that is an oligopeptide binding protein OppA2 (Accession Nos. gb|AAK72117.1; AY040221), about 41% identity from amino acids 1-569 with a protein from *Lactococcus lactis* subsp. *lactis* that is an oligopeptide-binding protein oppA precursor (Accession No. sp|Q07741|OPPA_LACLA), 41% identity from amino acids 1-569 with a protein from *Lactococcus lactis* that is an oligopeptide-binding protein oppA precursor (Accession No. sp|Q09144|OPPA_LACLC), and 40% identity from amino acids 1-569 with a protein from *Lactococcus lactis* subsp. *lactis* that is an oligopeptide ABC transporter substrate binding protein (Accession Nos. NP_267994.1; NC_002662).

A Gapped BlastP sequence alignment showed that SEQ ID NO:192 (385 amino acids) has about 30% identity from amino acids 69-380 with a protein from *Clostridium perfringens* that is homologous to a transposase (Accession Nos. NP_562803.1; NC_003366), about 30% identity from amino acids 66-381 with a protein from *Thermotoga maritima* that is a transposase in the IS605-TnpB family (Accession Nos. NP_228850.1; NC_000853), about 31% identity from amino acids 102-380 with a protein from *Clostridium perfringens* that is homologous to a transposase (Accession Nos. NP_561584.1; NC_003366), 28% identity from amino acids 70-380 with a protein from *Streptomyces coelicolor* that is homologous to a transposase (Accession No. pir||T36649), and 26% identity from amino acids 27-381 with a protein from *Nostoc* sp. PCC 7120 that is a transposase (Accession Nos. NP_490351.1; NC_003276).

A Gapped BlastP sequence alignment showed that SEQ ID NO:194 (323 amino acids) has about 91% identity from amino acids 1-323 with a protein from *Lactobacillus helveticus* that is an L-lactate dehydrogenase (L-LDH) (Accession No. sp|O32765|LDH_LACHE), about 66% identity from amino acids 8-323 with a protein from *Lactobacillus casei* that is an L-lactate dehydrogenase (L-LDH) (Accession No. sp|P00343|LDH_LACCA), about 66% identity from amino acids 1-323 with a protein from *Lactobacillus sakei* that is an L-lactate dehydrogenase (L-LDH) (Accession No. sp|P50934|LDH_LACSK), 65% identity from amino acids 8-323 with a protein from *Lactobacillus casei* that is an L-Lactate Dehydrogenase (E.C.1.1.1.27) complex with fructose-1,6-bisphosphate (FBP) and Co2+(Accession No. pdb|1LLC|), and 62% identity from amino acids 1-316 with a protein from *Lactobacillus pentosus* that is an L-lactate dehydrogenase (L-LDH) (Accession No. sp|P56511|LDH_LACPE).

A Gapped BlastP sequence alignment showed that SEQ ID NO: 196 (589 amino acids) has about 85% identity from amino acids 1-589 with a protein from *Lactobacillus delbrueckii* that is a pyruvate kinase (Accession No. sp|P34038|KPYK_LACDE), about 58% identity from amino acids 1-585 with a protein from *Listeria innocua* that is homologous to a pyruvate kinase (Accession Nos. NP_470941.1; NC_003212), about 58% identity from amino acids 1-585 with a protein from *Listeria monocytogenes* that is homologous to a pyruvate kinase (Accession Nos. NP_465095.1; NC_003210), 52% identity from amino acids 1-589 with a protein from *Sporosarcina psychrophila* that is a pyruvate kinase (Accession No. sp|P51182|KPYK_BACPY), and 53% identity from amino acids 2-589 with a protein from *Bacillus stearothermophilus* that is a pyruvate kinase (Accession No. sp|Q02499|KPYK_BACST).

A Gapped BlastP sequence alignment showed that SEQ ID NO:198 (299 amino acids) has about 40% identity from amino acids 5-290 with a protein from *Clostridium acetobutylicuni* that is a galactose mutarotase-related enzyme (Accession Nos. NP_349632.1; NC_003030), about 36% identity from amino acids 5-290 with a protein from *Listeria monocytogenes* that is homologous to a LacX protein (Accession Nos. NP_464808.1; NC_003210), about 35% identity from amino acids 5-290 with a protein from *Listeria innocua* that is homologous to a LacX protein (Accession Nos. NP_470658.1; NC_003212), 36% identity from amino acids 1-291 with a conserved hypothetical protein from *Clostridium perfringens* (Accession Nos. NP_561199.1; NC_003366), and 41% identity from amino acids 1-238 with a hypothetical protein from *Lactococcus lactis* subsp. *lactis* (Accession Nos. NP_268078.1; NC_002662).

A Gapped BlastP sequence alignment showed that SEQ ID NO:200 (356 amino acids) has about 79% identity from amino acids 6-356 with a protein from *Enterococcus faecalis* that is an RNA polymerase sigma factor RpoD (sigma-42) (Accession No. sp|P52329|RPSD_ENTFA), about 74% identity from amino acids 5-356 with a protein from *Listeria innocua* that is an RNA polymerase sigma factor RpoD (Accession Nos. NP_470827.1; NC 003212), about 74% identity from amino acids 5-356 with a protein from *Listeria monocytogenes* that is an RNA polymerase sigma factor RpoD (Accession Nos. NP_464979.1; NC_003210), 72% identity from amino acids 3-356 with a protein from *Staphylococcus aureus* subsp. *aureus* that is an RNA polymerase sigma factor (Accession Nos. NP_372085.1; NC_002758), and 72% identity from amino acids 3-356 with a protein from *Staphylococcus aureus* that is a sigma70 protein (Accession Nos. dbj|BAA19494.1; AB1001896).

A Gapped BlastP sequence alignment showed that SEQ ID NO:202 (756 amino acids) has about 61% identity from amino acids 1-739 with a protein from *Lactobacillus brevis* that is a maltose phosphorylase, chain A (Accession No. pdb|1H54|A), about 55% identity from amino acids 2-751 with a protein from *Listeria innocua* that is homologous to a maltosephosphorylase (Accession Nos. NP_471559.1; NC_003212), about 57% identity from amino acids 3-755 with a protein from *Neisseria meningitidis* that is homologous to a maltose phosphorylase (Accession Nos. NP_284795.1; NC_003116), 57% identity from amino acids 3-755 with a protein from *Neisseria meningitidis* that is a maltose phosphorylase (Accession Nos. NP_273439.1; NC_003112), and 55% identity from amino acids 2-740 with a protein from *Listeria monocytogenes* that is homologous to a maltosephosphorylase (Accession Nos. NP_465645.1; NC_003210).

A Gapped BlastP sequence alignment showed that SEQ ID NO:204 (552 amino acids) has about 25% identity from amino acids 203-478 with a hypothetical protein from *Aeropyrum pernix* (Accession Nos. NP_146913.1; NC_000854), about 28% identity from amino acids 113-267 with a protein from *Candida albicans* that is a phosphoenolpyruvate carboxykinase (ATP) (Accession No. sp|O13434|PPCK_CANAL), about 24% identity from amino acids 199-511 with a protein from *Mesorhizobium* loti that is a phosphoenolpyruvate carboxykinase (Accession Nos. NP_105818.1; NC_002678), 36% identity from amino acids 207-267 with a protein from *Trypanosoma brucei* that is a phosphoenolpyruvate carboxykinase (ATP) (glycosomal protein P60) (Accession No. sp|P13735|PPCK_TRYBB), and 36% identity from amino acids 207-267 with a protein from *Trypanosoma brucei* that is a phosphoenolpyruvate carboxykinase (ATP) (EC 4.1.1.49) (Accession No. pir||S48663).

A Gapped BlastP sequence alignment showed that SEQ ID NO:206 (285 amino acids) has about 58% identity from amino acids 5-285 with a protein from *Lactococcus lactis* subsp. *lactis* that is an oxidoreductase (Accession Nos. NP_266424.1; NC_002662), about 53% identity from amino acids 9-285 with a protein from *Streptococcus pyogenes* that is homologous to a reductase/dehydrogenase (Accession Nos. NP_269725.1; NC_002737), about 53% identity from amino acids 9-285 with a protein from *Streptococcus pyogenes* that is homologous to a reductase/dehydrogenase (Accession Nos. NP_607738.1; NC_003485), 54% identity from amino acids 8-285 with a protein from *Streptococcus pneumoniae* that is an oxidoreductase in the aldo/keto reductase family (Accession Nos. NP_345932.1; NC_003028), and 48% identity from amino acids 5-285 with a protein from *Listeria monocytogenes* that is homologous to an oxydoreductase (Accession Nos. NP_464350.1; NC_003210).

A Gapped BlastP sequence alignment showed that SEQ ID NO:208 (176 amino acids) has about 60% identity from amino acids 5-176 with a protein from *Eubacterium* sp. that is a single-stranded DNA-binding protein (Accession No. pir||S67490), about 57% identity from amino acids 5-176 with a protein from *Listeria innocua* that is homologous to a single-strand binding protein (SSB) (Accession Nos. NP_469385.1; NC_003212), about 53% identity from amino acids 5-176 with a protein from *Bacillus halodurans* that is a single-strand DNA-binding protein (phage-related protein) (Accession Nos. NP_244917.1; NC_002570), 53% identity from amino acids 5-176 with a protein from *Enterococcus faecalis* that is a single-strand binding protein (Accession Nos. NP_072022.1; NC_002630), and 52% identity from amino acids 5-176 with a protein from *Listeria monocytogenes* that is homologous to a single-stranded DNA-binding protein (Accession Nos. NP_465832.1; NC_003210).

A Gapped BlastP sequence alignment showed that SEQ ID NO:210 (269 amino acids) has about 69% identity from amino acids 1-269 with a protein from *Listeria innocua* that is homologous to a PTS system mannose-specific, factor IIC (Accession Nos. NP_469489.1; NC_003212), about 69% identity from amino acids 1-269 with a protein from *Listeria monocytogenes* that is homologous to a PTS system mannose-specific, factor IIC (Accession Nos. NP_463630.1; NC_003210), about 67% identity from amino acids 1-269 with a protein from *Streptococcus pneumoniae* that is a PTS system, mannose-specific IIC component (Accession Nos. NP_344821.1; NC_003028), 65% identity from amino acids 1-269 with a protein from *Streptococcus pyogenes* that is homologous to a mannose-specific phosphotransferase system component IIC (Accession Nos. NP_269762.1; NC_002737), and 64% identity from amino acids 1-269 with a protein from *Clostridium acetobutylicum* that is a mannose/fructose-specific phosphotransferase system component IIC (Accession Nos. NP_149231.1; NC_001988).

A Gapped BlastP sequence alignment showed that SEQ ID NO:212 (450 amino acids) has about 33% identity from amino acids 9-427 with a protein from *Lactococcus lactis* subsp. *lactis* that is a transport protein (Accession Nos. NP_267991.1; NC_002662), about 31% identity from amino acids 6-440 with a protein from *Listeria monocytogenes* (Accession Nos. NP_465756.1; NC_003210), about 31% identity from amino acids 6-440 with a protein from *Listeria* innocua (Accession Nos. NP_471665.1; NC_003212), 30% identity from amino acids 10-444 with a protein from *Bacillus subtilis* (Accession Nos. NP_391008.1; NC_000964), and 31% identity from amino acids 9-435 with a hypothetical protein from *Staphylococcus aureus* subsp. *aureus* (Accession Nos. NP_371226.1; NC_002758).

A Gapped BlastP sequence alignment showed that SEQ ID NO:214 (697 amino acids) has about 69% identity from amino acids 5-695 with a protein from *Geobacillus stearothermophilus* that is a translation elongation factor G (EF-G) (Accession Nos. emb|CACO9927.1; AJ249559), about 69% identity from amino acids 5-695 with a protein from *Bacillus subtilis* that is an elongation factor G (Accession Nos. NP_387993.1; NC_000964), about 71% identity from amino acids 5-695 with a protein from *Streptococcus pneumoniae* that is a translation elongation factor G (Accession Nos. NP_344811.1; NC_003028), 71% identity from amino acids 5-695 with a protein from *Streptococcus pyogenes* that is a translation elongation factor G (EF-G) (Accession Nos. NP_268626.1; NC_002737), and 69% identity from amino acids 5-695 with a protein from *Bacillus halodurans* that is a translation elongation factor G (EF-G) (Accession Nos. NP_240997.1; NC_002570).

A Gapped BlastP sequence alignment showed that SEQ ID NO:216 (320 amino acids) has about 100% identity from amino acids 1-320 with a protein from *Lactobacillus acidophilus* that is an F1F0-ATPase subunit gamma (Accession Nos. gb|AAF22497.1; AF098522), about 48% identity from amino acids 1-320 with a protein from *Enterococcus faecalis* that is an ATP synthase gamma chain (Accession No. sp|P43452|ATPG_ENTHR), about 45% identity from amino acids 1-320 with a protein from *Streptococcus sanguinis* that is a proton-translocating ATPase gamma subunit (Accession Nos. gb|AADO0917.1; AF001955), 44% identity from amino acids 1-320 with a protein from *Streptococcus pneumoniae* that is an ATP synthase F1, gamma subunit (Accession Nos. NP_345960.1; NC_003028), and 44% identity from amino acids 1-320 with a protein from *Streptococcus mutans* that is an ATP synthase gamma chain (Accession No. sp|P95788|ATPG_STRMU).

A Gapped BlastP sequence alignment showed that SEQ ID NO:218 (182 amino acids) has about 100% identity from amino acids 1-182 with a protein from *Lactobacillus acidophilus* that is an F1F0-ATPase subunit delta (Accession Nos. gb|AAF22495.1; AF098522), about 37% identity from amino acids 3-179 with a protein from Geobacillus stearothermophilus that is an ATP synthase delta chain (Accession No. sp|P42008|ATPD_BACST), about 35% identity from amino acids 1-178 with a protein from *Enterococcus faecalis* that is an ATP synthase delta chain (Accession No. sp|P26680|ATPD_ENTHR), 36% identity from amino acids 3-179 with a protein from *Bacillus* caldotenax that is an ATP synthase delta chain (Accession No.

sp|P41011|ATPD_BACCA), and 33% identity from amino acids 3-179 with a protein from *Bacillus* sp. PS3 that is an ATP synthase delta chain (Accession No. sp|P09220|ATPD_BACP3).

A Gapped BlastP sequence alignment showed that SEQ ID NO:220 (257 amino acids) has about 63% identity from amino acids 7-247 with a hypothetical protein from *Staphylococcus aureus* subsp. *aureus* (Accession Nos. NP_370666.1; NC_002758), about 61% identity from amino acids 6-247 with a protein from *Bacillus halodurans* that is a transport system protein (Accession Nos. NP_241306.1; NC_002570), about 58% identity from amino acids 6-247 with a protein from *Bacillus halodurans* that is an alkylphosphonate ABC tranporter (ATP-binding protein) (Accession Nos. NP_243840.1; NC_002570), 50% identity from amino acids 6-247 with a protein from *Lactococcus lactis* subsp. *lactis* that is a phosphonate ABC transporter ATP-binding protein (Accession Nos. NP_266456.1; NC_002662), and 51% identity from amino acids 6-242 with a protein from *Bacillus halodurans* that is a phosphonate transport system protein (Accession Nos. NP_241335.1; NC_002570).

A Gapped BlastP sequence alignment showed that SEQ ID NO:222 (639 amino acids) has about 57% identity from amino acids 6-639 with a protein from *Leuconostoc lactis* that is a lactose permease (Accession No. sp|Q48624|LACY_LEULA), about 38% identity from amino acids 2-636 with a protein from *Lactobacillus plantarum* that is homologous to a raffinose permease (Accession Nos. gb|AAL09166.1; AY048859), about 36% identity from amino acids 11-637 with a protein from *Streptococcus salivarius* that is a lactose transport protein (Accession Nos. gb|AAL67293.1; AF389474), 36% identity from amino acids 11-637 with a protein from *Streptococcus thermophilus* that is a lactose transport protein (Accession Nos. gb|AAL67300.1; AF389475), and 36% identity from amino acids 21-610 with a protein from *Pediococcus pentosaceus* that is a raffinose carrier protein (raffinose perm ease) (Accession No. sp|P43466|RAFP_PEDPE).

A Gapped BlastP sequence alignment showed that SEQ ID NO:224 (230 amino acids) has about 67% identity from amino acids 3-225 with a protein from *Neisseria meningitidis* that is a phosphoglycerate mutase (Accession Nos. NP_274610.1; NC_003112), about 66% identity from amino acids 3-225 with a protein from *Neisseria meningitidis* that is a phosphoglycerate mutase (Accession Nos. NP_284514.1; NC_003116), about 67% identity from amino acids 3-225 with a protein from *Pasteurella multocida* that is a GpmA protein (Accession Nos. NP_246445.1; NC_002663), 63% identity from amino acids 1-225 with a protein from *Streptococcus pyogenes* that is homologous to a phosphoglycerate mutase (Accession Nos. NP_607520.1; NC_003485), and 64% identity from amino acids 1-225 with a protein from *Streptococcus thermophilus* that is a phosphoglycerate mutase (Accession Nos. gb|AAL35381.1; AF442555).

A Gapped BlastP sequence alignment showed that SEQ ID NO:226 (349 amino acids) has about 96% identity from amino acids 13-349 with a protein from *Lactobacillus johnsonii* that is a D-lactate dehydrogenase (Accession Nos. gb|AAC99363.1; AF071558), about 95% identity from amino acids 13-349 with a protein from *Lactobacillus helveticus* that is a D-lactate dehydrogenase (D-LDH) (Accession No. sp|P30901|LDHD_LACHE), about 86% identity from amino acids 13-342 with a protein from *Lactobacillus delbrueckii* that is a D-lactate dehydrogenase (D-LDH) (Accession No. sp|P26297|LDHD_LACDE), 86% identity from amino acids 13-342 with a protein from *Lactobacillus delbrueckii* that is a D-lactate dehydrogenase (Accession Nos. emb|CAA42781.1; X60220), and 64% identity from amino acids 15-338 with a protein from *Leuconostoc mesenteroides* that is a D-lactate dehydrogenase (D-LDH) (Accession No. sp|P5101|LDHD_LEUMC).

A Gapped BlastP sequence alignment showed that SEQ ID NO:228 (169 amino acids) has about 100% identity from amino acids 1-169 with a protein from *Lactobacillus acidophilus* that is an F1F0-ATPase subunit b (Accession Nos. gb|AAF22494.1; AF098522), about 40% identity from amino acids 15-169 with a protein from *Streptococcus pneumoniae* that is a ATP synthase B chain (subunit I) (Accession No. sp|Q59952|ATPF_STRPN), about 39% identity from amino acids 15-167 with a protein from *Enterococcus faecalis* that is an ATP synthase B chain (Accession No. sp|P26681|ATPF_ENTHR), 39% identity from amino acids 15-169 with a protein from *Streptococcus pneumoniae* that is an ATP synthase F0, B subunit (Accession Nos. NP_345963.1; NC_003028), and 41% identity from amino acids 15-169 with a protein from *Streptococcus sanguinis* that is a proton-translocating ATPase b subunit (Accession Nos. gb|AAD00914.1; AF001955).

A Gapped BlastP sequence alignment showed that SEQ ID NO:230 (332 amino acids) has about 100% identity from amino acids 17-332 with a protein from *Lactobacillus acidophilus* that is a beta-galactosidase small subunit (lactase) (Accession No. sp|O07685|BGAM_LACAC), about 64% identity from amino acids 17-332 with a protein from *Lactobacillus plantarum* that is a beta-galactosidase small subunit (Accession Nos. gb|AAL09168.1; AY048860), about 64% identity from amino acids 17-332 with a protein from *Leuconostoc lactis* that is a beta-galactosidase small subunit (Accession No. sp|Q02604|BGAM_LEULA), 57% identity from amino acids 17-332 with a protein from *Lactobacillus sakei* that is a beta-galactosidase small subunit (Accession No. sp|Q48847|BGAM_LACSK), and 32% identity from amino acids 23-332 with a protein from *Bacillus halodurans* that is a beta-galactosidase (Accession Nos. NP_243589.1; NC_002570).

A Gapped BlastP sequence alignment showed that SEQ ID NO:232 (387 amino acids) has about 89% identity from amino acids 1-387 with a protein from *Lactobacillis helveticus* that is a galactokinase (galactose kinase) (Accession No. sp|Q00052|GAL1_LACHE), about 52% identity from amino acids 1-387 with a protein from *Lactobacillus casei* that is a galactokinase (galactose kinase) (Accession No. sp|O84902|GAL1_LACCA), about 54% identity from amino acids 1-385 with a protein from *Streptococcus pneumoniae* that is a galactokinase (Accession Nos. NP_346285.1; NC_003028), 55% identity from amino acids 1-385 with a protein from *Streptococcus mutans* that is a galactokinase (galactose kinase) (Accession No. sp|P96993|GAL1_STRMU), and 54% identity from amino acids 1-385 with a protein from *Streptococcus pneumoniae* that is a galactokinase (Accession Nos. NP_359260.1; NC_003098).

A Gapped BlastP sequence alignment showed that SEQ ID NO:234 (225 amino acids) has about 46% identity from amino acids 2-222 with a hypothetical protein from *Escherichia coli* (Accession Nos. NP_309933.1; NC_002695), about 47% identity from amino acids 11-222 with a protein from *Escherichia coli* (Accession Nos. NP_287861.1; NC_002655), about 41% identity from amino acids 11-225 with a conserved hypothetical protein from *Xylella fastidiosa* (Accession Nos. NP_299036.1; NC_002488), 27% identity from amino acids 13-222 with a conserved protein from

*Bacillus halodurans* (Accession Nos. NP_242386.1; NC_002570), and 27% identity from amino acids 13-221 with a hypothetical protein from *Saccharomyces cerevisiae* (Accession Nos. NP_013808.1; NC_001145).

A Gapped BlastP sequence alignment showed that SEQ ID NO:236 (431 amino acids) has about 52% identity from amino acids 2-430 with a protein from *Lactococcus lactis* subsp. *lactis* that is a preprotein translocase SecY subunit (Accession Nos. NP_268235.1; NC_002662), about 52% identity from amino acids 2-430 with a protein from *Lactococcus lactis* subsp. *lactis* that is a preprotein translocase secY subunit (Accession No. sp|P27148|SECY_LACLC), about 55% identity from amino acids 5-430 with a protein from *Streptococcus pyogenes* that is homologous to a preprotein translocase (Accession Nos. NP_268480.1; NC_002737), 53% identity from amino acids 2-430 with a protein from *Streptococcus pneumoniae* that is a preprotein translocase, SecY subunit (Accession Nos. NP_344770.1; NC_003028), and 51% identity from amino acids 1-431 with a protein from *Listeria innocua* that is homologous to a preprotein translocase subunit (Accession Nos. NP_472090.1; NC_003212).

A Gapped BlastP sequence alignment showed that SEQ ID NO:238 (456 amino acids) has about 36% identity from amino acids 9-374 with a protein from *Lactococcus lactis* subsp. *lactis* that is an amino acid permease (Accession Nos. NP_266224.1; NC_002662), about 31% identity from amino acids 1-429 with a protein from *Streptococcus pyogenes* that is homologous to a cationic amino acid transporter (Accession Nos. NP_608096.1; NC 003485), about 30% identity from amino acids 1-429 with a protein from *Streptococcus pyogenes* that is homologous to a cationic amino acid transporter protein (Accession Nos. NP_270019.1; NC_002737), 27% identity from amino acids 10-407 with a hypothetical protein from *Mycobacterium tuberculosis* (Accession Nos. NP_216495.1; NC_000962), and 27% identity from amino acids 10-407 with a protein from *Mycobacterium tuberculosis* that is an amino acid permease (Accession Nos. NP_336492.1; NC_002755).

A Gapped BlastP sequence alignment showed that SEQ ID NO:240 (235 amino acids) has about 51% identity from amino acids 1-214 with a protein from *Listeria monocytogenes* (Accession Nos. NP_464081.1; NC_003210), about 50% identity from amino acids 1-214 with a protein from *Listeria innocua* (Accession Nos. NP_469905.1; NC_003212), about 27% identity from amino acids 1-205 with a conserved hypothetical protein from *Clostridium perfringens* (Accession Nos. NP_563079.1; NC_003366), 43% identity from amino acids 145-215 with a protein from *Lactobacillus plantarum* (Accession Nos. emb|CAA68245.1; X99978), and 27% identity from amino acids 15-122 with a conserved hypothetical membrane protein from *Sinorhizobium meliloti* (Accession Nos. NP_437588.1; NC_003078).

A Gapped BlastP sequence alignment showed that SEQ ID NO:242 (77 amino acids) has about 100% identity from amino acids 1-77 with a protein from *Lactobacillus acidophilus* that is an F1F0-ATPase subunit c (Accession Nos. gb|AAF22493.1; AF098522), about 67% identity from amino acids 10-76 with a protein from *Enterococcus faecalis* that is an H+-transporting ATP synthase (EC 3.6.1.34) lipid-binding protein (Accession No. pir||JN0362), about 65% identity from amino acids 10-76 with a protein from *Enterococcus faecalis* that is an ATP synthase C chain (lipid-binding protein) (Accession No. sp|P26682|ATPL_ENTHR), 60% identity from amino acids 11-73 with a protein from *Staphylococcus aureus* subsp. *aureus* that is an ATP synthase C chain (Accession Nos. NP_372632.1; NC_002758), and 60% identity from amino acids 11-74 with a protein from *Bacillus megaterium* that is an ATP synthase C chain (lipid-binding protein) (Accession No. sp|P20603|ATPL_BACME).

A Gapped BlastP sequence alignment showed that SEQ ID NO:244 (628 amino acids) has about 99% identity from amino acids 1-628 with a protein from *Lactobacillus acidophilus* that is a beta-galactosidase large subunit (lactase) (Accession No. sp|O07684|BGAL_LACAC), about 63% identity from amino acids 1-628 with a protein from *Leuconostoc lactis* that is a beta-galactosidase large subunit (lactase) (Accession No. sp|Q02603|BGAL_LEULA), about 59% identity from amino acids 1-628 with a protein from *Lactobacillus sakei* that is a beta-galactosidase large subunit (lactase) (Accession No. sp|Q48846|BGAL_LACSK), 65% identity from amino acids 148-628 with a protein from *Lactobacillus plantarum* that is a beta-galactosidase large subunit (Accession Nos. gb|AAL09167.1; AY048860), and 47% identity from amino acids 3-624 with a protein from *Bacillus halodurans* that is a beta-galactosidase (Accession Nos. NP_243589.1; NC_002570).

A Gapped BlastP sequence alignment showed that SEQ ID NO:246 (182 amino acids) has about 41% identity from amino acids 1-182 with a protein from *Streptococcus pneumoniae* that is homologous to an oxidoreductase (Accession Nos. NP_345926.1; NC_003028), about 41% identity from amino acids 1-182 with a hypothetical protein from *Streptococcus pneumoniae* (Accession Nos. NP_358919.1; NC_003098), about 46% identity from amino acids 1-153 with a protein from *Streptococcus mitis* (Accession Nos. gb|AAG18632.1; AY007504), 43% identity from amino acids 1-182 with a conserved hypothetical protein from *Streptococcus pneumoniae* (Accession Nos. NP_358918.1; NC_003098), and 43% identity from amino acids 1-182 with a protein from *Streptococcus pneumoniae* that is homologous to an oxidoreductase (Accession Nos. NP_345925.1; NC_003028).

A Gapped BlastP sequence alignment showed that SEQ ID NO:248 (429 amino acids) has about 65% identity from amino acids 1-427 with a protein from *Streptococcus pyogenes* that is homologous to an adenylosuccinate synthetase (Accession Nos. NP_606464.1; NC_003485), about 65% identity from amino acids 1-427 with a protein from *Streptococcus pyogenes* that is homologous to an adenylosuccinate synthetase (Accession Nos. NP_268541.1; NC_002737), about 65% identity from amino acids 1-427 with a protein from *Streptococcus pneumoniae* that is an adenylosuccinate synthetase (Accession Nos. NP_344571.1; NC_003028), 62% identity from amino acids 1-425 with a protein from *Bacillus subtilis* that is an adenylosuccinate synthetase (Accession Nos. NP_391922.1; NC_000964), and 62% identity from amino acids 1-429 with a protein from *Listeria innocua* that is homologous to an adenylosuccinate synthetase (Accession Nos. NP_469395.1; NC_003212).

A Gapped BlastP sequence alignment showed that SEQ ID NO:250 (320 amino acids) has about 75% identity from amino acids 1-319 with a protein from *Lactobacillus delbrueckii* that is a 6-phosphofructokinase (phosphofructokinase) (phosphohexokinase) (Accession No. sp|P80019|K6PF_LACDE), about 57% identity from amino acids 1-313 with a protein from *Listeria monocytogenes* that is homologous to a 6-phosphofructokinase (Accession Nos. NP_465096.1; NC_003210), about 56% identity from amino acids 1-313 with a protein from *Listeria innocua* (Accession Nos. NP_470942.1; NC_003212), 62% identity from amino acids 1-297 with a protein from *Streptococcus pyogenes* that is homologous to a 6-phosphofructokinase (Accession Nos. NP_269410.1; NC_002737), and 62% identity from amino acids 1-297 with a protein from *Streptococcus pyogenes* that is homologous to a 6-phosphofructokinase (Accession Nos. NP_607342.1; NC_003485).

A Gapped BlastP sequence alignment showed that SEQ ID NO:252 (1217 amino acids) has about 66% identity from amino acids 1-1203 with a protein from *Bacillus subtilis* that is a DNA-directed RNA polymerase beta chain (transcriptase beta chain) (RNA polymerase beta subunit) (Accession No. sp|P37871|RPOC_BACSU), about 66% identity from amino acids 1-1058 with a protein from *Bacillus anthracis* that is a DNA-directed RNA polymerase beta chain (transcriptase beta chain) (Accession No. sp|P77819|RPOC_BACAN), about 67% identity from amino acids 68-1068 with a protein from Oenococcus oeni that is a DNA-directed RNA polymerase beta chain (transcriptase beta chain) (RNA polymerase beta subunit) (Accession No. sp|P95405|RPOC_OENOE), 67% identity from amino acids 1-1058 with a protein from *Bacillus anthracis* that is a DNA-directed RNA polymerase (Accession Nos. emb|CAA61514.1; X89230), and 71% identity from amino acids 1-1058 with a protein from *Pediococcus acidilactici* that is a DNA-directed RNA polymerase beta chain (transcriptase beta chain) (RNA polymerase beta subunit) (Accession No. sp|P77917|RPOC_PEDAC).

A Gapped BlastP sequence alignment showed that SEQ ID NO:254 (308 amino acids) has about 55% identity from amino acids 12-302 with a protein from *Staphylococcus aureus* subsp. *aureus* that is homologous to a GTP-binding protein (Accession Nos. NP_372091.1; NC_002758), about 52% identity from amino acids 8-306 with a protein from *Bacillus subtilis* that is a GTP-binding protein (Accession Nos. NP_390407.1; NC_000964), about 53% identity from amino acids 9-306 with a protein from *Bacillus halodurans* that is a GTP-binding protein (Era/ThdF family) (Accession Nos. NP_242233.1; NC_002570), 55% identity from amino acids 13-306 with a protein from *Listeria monocytogenes* that is homologous to a GTP binding protein (Accession Nos. NP_464987.1; NC_003210), and 54% identity from amino acids 13-306 with a protein from *Listeria innocua* that is homologous to a GTP binding protein (Accession Nos. NP_470835.1; NC_003212).

A Gapped BlastP sequence alignment showed that SEQ ID NO:256 (1213 amino acids) has about 60% identity from amino acids 179-1066 with a protein from *Clostridium argentinense* that is a DNA-dependent RNA polymerase subunit beta (Accession Nos. emb|CAC10527.1; Y16472), about 65% identity from amino acids 29-1178 with a protein from *Staphylococcus saccharolyticus* that is an RNA polymerase B-subunit (Accession Nos. gb|AAL37309.1; AF325871), about 68% identity from amino acids 12-1113 with a protein from *Bacillus licheniformis* that is an RNA polymerase beta subunit (Accession Nos. gb|AAD48492.1; AF172323), 66% identity from amino acids 4-1178 with a protein from *Staphylococcus aureus* subsp. *aureus* that is an RNA polymerase beta chain (Accession Nos. NP_371066.1; NC_002758), and 67% identity from amino acids 29-1153 with a protein from *Staphylococcus intermedius* that is an RNA polymerase B-subunit (Accession Nos. gb|AAL37307.1; AF325869).

A Gapped BlastP sequence alignment showed that SEQ ID NO:258 (598 amino acids) has about 49% identity from amino acids 3-598 with a protein from *Bacillus licheniformis* that is a thimet oligopeptidase (EC 3.4.24.15) (Accession No. pir||T44581), about 49% identity from amino acids 3-598 with a protein from *Bacillus subtilis* that is homologous to an oligoendopeptidase (Accession Nos. NP_389036.1; NC_000964), about 51% identity from amino acids 6-598 with a protein from *Streptococcus pneumoniae* that is a group B oligopeptidase (Accession Nos. NP_358476.1; NC_003098), about 51% identity from amino acids 6-598 with a protein from *Streptococcus pneumoniae* that is an oligoendopeptidase F (Accession Nos. NP_345460.1; NC_003028), and about 49% identity from amino acids 6-598 with a protein from *Lactococcus lactis* that is an oligoendopeptidase F (Accession No. sp|P54124|PEF1_LACLC).

A Gapped BlastP sequence alignment showed that SEQ ID NO:260 (687 amino acids) has about 45% identity from amino acids 1-687 with a protein from *Listeria innocua* that is homologous to a glycyl-tRNA synthetase beta chain (Accession Nos. NP_470831.1; NC_003212), about 49% identity from amino acids 1-687 with a protein from *Streptococcus pyogenes* that is homologous to a glycyl-tRNA synthetase (beta subunit) (Accession Nos. NP_607735.1; NC_003485), about 50% identity from amino acids 1-668 with a protein from *Streptococcus pyogenes* that is homologous to a glycyl-tRNA synthetase (beta subunit) (Accession Nos. NP_269722.1; NC_002737), about 44% identity from amino acids 1-687 with a protein from *Listeria monocytogenes* that is homologous to a glycyl-tRNA synthetase beta chain (Accession Nos. NP_464983.1; NC_003210), and about 45% identity from amino acids 3-687 with a protein from *Bacillus subtilis* that is a glycyl-tRNA synthetase (beta subunit) (Accession Nos. NP_390404.1; NC_000964).

A Gapped BlastP sequence alignment showed that SEQ ID NO:262 (304 amino acids) has about 67% identity from amino acids 7-302 with a protein from *Leuconostoc mesenteroides* that is a citrate lyase beta chain (citrase) (citryl-CoA lyase subunit) (Accession No. sp|O53078|CILB_LEUMC), about 66% identity from amino acids 1-304 with a protein from Weissellaparamesenteroicles that is a citrate (pro-3S)-lyase (EC 4.1.3.6) beta chain (Accession No. pir||T46730), about 66% identity from amino acids 4-302 with a protein from *Lactococcus lactis* subsp. *lactis* that is a citrate lyase beta chain (EC 4.1.3.6) (Accession Nos. NP_267346.1; NC_002662), about 55% identity from amino acids 7-298 with a protein from *Clostridium perfringens* that is a citrate lyase beta subunit (Accession Nos. NP_562064.1; NC_003366), and about 53% identity from amino acids 4-298 with a protein from *Fusobacterium nucleatum* subsp. *nucleatum* that is a citrate lyase beta chain; citryl-CoA lyase subunit (Accession Nos. NP_604276.1; NC_003454).

A Gapped BlastP sequence alignment showed that SEQ ID NO:264 (174 amino acids) has about 44% identity from amino acids 23-161 with a protein from *Streptococcus mutans* (Accession Nos. gb|AAC38046.1; AF000954), about 42% identity from amino acids 6-161 with a conserved hypothetical protein from *Staphylococcus aureus* subsp. *aureus* (Accession Nos. NP_372094.1; NC_002758), about 43% identity from amino acids 28-161 with a conserved hypothetical protein from *Streptococcus pneumoniae* (Accession Nos. NP_358463.1; NC_003098), about 42% identity from amino acids 28-161 with a conserved hypothetical protein from *Streptococcus pneumoniae* (Accession Nos. NP_345448.1; NC_003028), and about 43% identity from amino acids 10-161 with a conserved hypothetical protein from *Streptococcus pyogenes* (Accession Nos. NP_268764.1; NC_002737).

A Gapped BlastP sequence alignment showed that SEQ ID NO:266 (495 amino acids) has about 63% identity from amino acids 1-473 with a protein from *Lactobacillus reuteri* that is an autoaggregation-mediating protein (Accession Nos. gb|AAD20136.1; AF091502), about 64% identity from amino acids 2-439 with a protein from *Listeria moliocytogenes* that is homologous to an ATP-dependent RNA helicase (Accession Nos. NP_464392.1; NC_003210), about 64% identity from amino acids 2-439 with a protein from *Listeria innocua* that is homologous to an ATP-dependent RNA helicase (Accession Nos. NP_470201.1; NC_003212), about 55% identity from amino acids 1-480 with a protein from *Bacillus subtilis* that is homologous to an ATP-dependent RNA helicase (Accession Nos. NP_388339.1; NC_000964), and about 58% identity from amino acids 1-441 with a protein from *Streptococcus pyogenes* that is homologous to an ATP-dependent RNA helicase (Accession Nos. NP_269508.1; NC_002737).

A Gapped BlastP sequence alignment showed that SEQ ID NO:268 (303 amino acids) has about 57% identity from amino acids 5-283 with a protein from *Streptococcus bovis* that is a class-II aldolase (Accession Nos. dbj|BAB16889.1; ABO50113), about 54% identity from amino acids 5-283 with a protein from *Streptococcus pyogenes* that is homologous to a fructose-bisphosphate aldolase (Accession Nos. NP_269879.1; NC_002737), about 53% identity from amino acids 5-284 with a protein from *Streptococcus pneumoniae* that is a fructose-bisphosphate aldolase (Accession Nos. NP_345117.1; NC_003028), about 56% identity from amino acids 24-283 with a protein from *Streptococcus thermophilus* that is a fructose-1,6-phosphate aldolase (Accession Nos. gb|AAL35376.1; AF442550), and about 55% identity from amino acids 5-283 with a protein from *Clostridium acetobutylicum* that is a fructose-bisphosphate aldolase (Accession Nos. NP_347463.1; NC_003030).

A Gapped BlastP sequence alignment showed that SEQ ID NO:270 (113 amino acids) has about 46% identity from amino acids 1-102 with a protein from *Streptococcus pneumoniae* that is a histidyl-tRNA synthetase (Accession Nos. NP_359522.1; NC_003098), about 46% identity from amino acidsl-102 with a protein from *Streptococcus pneumoniae* that is a histidyl-tRNA synthetase (Accession Nos. NP_346540.1; NC_003028), about 40% identity from amino acids 1-101 with a protein from *Streptococcus pyogeties* that is homologous to a histidine-tRNA ligase (Accession Nos. NP_608134.1; NC_003485), about 39% identity from amino acids 1-101 with a protein from *Streptococcus pyogenes* that is homologous to a histidine-tRNA ligase (Accession Nos. NP_270073.1; NC_002737), and about 35% identity from amino acids 1-101 with a protein from *Bacillus halodurans* that is a histidyl-tRNA synthetase (Accession Nos. NP_242117.1; NC_002570).

A Gapped BlastP sequence alignment showed that SEQ ID NO:272 (235 amino acids) has about 71% identity from amino acids 33-235 with a protein from *Streptococcus pyogenes* that is a 30S ribosomal protein S4 (Accession Nos. NP_270088.1; NC_002737), about 70% identity from amino acids 33-235 with a protein from *Streptococcus pneumoniae* that is a ribosomal protein S4 (Accession Nos. NP_344633.1; NC_003028), about 69% identity from amino acids 33-235 with a protein from *Lactococcus lactis* subsp. *lactis* that is a 30S ribosomal protein S4 (Accession Nos. NP_266440.1; NC_002662), about 67% identity from amino acids 33-233 with a protein from *Bacillus subtilis* that is a ribosomal protein S4 (BS4) (Accession Nos. NP_390844.1; NC_000964), and about 67% identity from amino acids 33-233 with a protein from *Bacillus halodurans* that is a 30S ribosomal protein S4 (Accession Nos. NP_244075.1; NC_002570).

A Gapped BlastP sequence alignment showed that SEQ ID NO:274 (452 amino acids) has about 61% identity from amino acids 1-449 with a protein from *Bacillus subtilis* that is homologous to a phosphoglucomutase (Accession Nos. NP_388058.1; NC_000964), about 61% identity from amino acids 1-449 with a protein from *Bacillus subtilis* that is a ybbT protein (Accession Nos. dbj|BAA33070.1; AB006424), about 59% identity from amino acids 1-451 with a protein from *Listeria monocytogenes* that is homologous to a phosphoglucomutase (Accession Nos. NP_465642.1; NC_003210), about 59% identity from amino acids 1-451 with a protein from *Listeria innocua* that is homologous to a phosphoglucomutase (Accession Nos. NP_471556.1; NC_003212), and about 59% identity from amino acids 1-449 with a protein from *Bacillus halodurans* that is a phosphoglucosamine mutase (Accession Nos. NP_241133.1; NC_002570).

A Gapped BlastP sequence alignment showed that SEQ ID NO:276 (309 amino acids) has about 62% identity from amino acids 3-307 with a protein from *Streptococcus pneumoniae* that is a cysteine synthase (Accession Nos. NP_346621.1; NC_003028), about 62% identity from amino acids 3-307 with a protein from *Streptococcus pneumoniae* that is a cysteine synthase, O-acetylserine sulfhydrylase (Accession Nos. NP_359606.1; NC_003098), about 62% identity from amino acids 6-308 with a protein from *Staphylococcus aureus* subsp. *aureus* that is homologous to a cysteine synthase (o-acetylserine sulfhydrylase) (Accession Nos. NP_371037.1; NC_002758), about 61% identity from amino acids 1-308 with a protein from *Streptococcus pyogenes* that is homologous to an O-acetylserine lyase (Accession Nos. NP_269670.1; NC_002737), and about 60% identity from amino acids 1-308 with a protein from *Streptococcus pyogenes* that is homologous to an O-acetylserine lyase (Accession Nos. NP_607680.1; NC_003485).

A Gapped BlastP sequence alignment showed that SEQ ID NO:278 (242 amino acids) has about 62% identity from amino acids 1-238 with a protein from *Listeria monocytogenes* (Accession Nos. NP_465060.1; NC_003210), about 61% identity from amino acids 1-238 with a protein from *Listeria innocua* (Accession Nos. NP_470906.1; NC_003212), about 57% identity from amino acids 1-236 with a protein from *Bacillus subtilis* that is homologous to a spore coat protein (Accession Nos. NP_390660.1; NC_000964), about 50% identity from amino acids 1-235 with a 27.2 kDa protein from *Clostridium histolyticum* (Accession No. sp|Q9ZNK0|YEBC_CLOHI), and about 51% identity from amino acids 1-235 with a conserved protein from *Clostridium acetobutylicum* that is a member of the YebC family (Accession Nos. NP_348911.1; NC_003030).

A Gapped BlastP sequence alignment showed that SEQ ID NO:280 (146 amino acids) has about 100% identity from amino acids 1-146 with a protein from *Lactobacillus acidophilus* that is an F1F0-ATPase subunit epsilon (Accession Nos. gb|AAF22499.1; AF098522), about 52% identity from amino acids 5-140 with a protein from *Enterococcus faecalis* that is an ATP synthase epsilon chain (Accession No. sp|P43453|ATPE_ENTHR), about 51% identity from amino acids 10-142 with a protein from *Streptococcus bovis* that is a proton-translocating ATPase, epsilon subunit (Accession Nos. dbj|BAA23756.1; AB009314), about 51% identity from amino acids 10-140 with a protein from *Streptococcus pyogenes* that is homologous to a proton-translocating ATPase, epsilon subunit (Accession Nos. NP_268983.1; NC_002737), and about 48% identity from amino acids 10-140 with a protein from *Streptococcus mutans* that is an ATP synthase epsilon chain (Accession No. sp|P95790|ATPE_STRMU).

A Gapped BlastP sequence alignment showed that SEQ ID NO:282 (442 amino acids) has about 56% identity from amino acids 1-423 with a protein from *Streptococcus pneumoniae* that is a trigger factor (Accession Nos. NP_357956.1; NC_003098), about 56% identity from amino acids 1-423 with a protein from *Streptococcus pneumoniae* that is a trigger factor (Accession Nos. NP_344923.1; NC_003028), about 55% identity from amino acids 1-423 with a protein from *Streptococcus pyogenes* that is a RopA protein (Accession Nos. NP_607953.1; NC_003485), about 55% identity from amino acids 1-423 with a protein from *Streptococcus pyogenes* that is a RopA protein (Accession Nos. gb|AAC82391.1; AF073922), and about 54% identity from amino acids 1-423 with a protein from *Streptococcus pyogenes* that is a transcription regulator—[trigger factor (prolyl isomerase)](Accession Nos. NP_269883.1; NC 002737).

The top blast result for even SEQ ID NOS:284-370 is shown in Table 3.

Example 2

Proteins Induced at Low pH

The most highly expressed proteins by *L. acidophilus* during growth at pH 4.5 and 5.5 were determined by microarray analysis according to the methods that follow. The results are shown in Tables 4 and 5.

RNA Isolation

For acid stress assays, aliquots (10 ml) of *L. acidophilus* cultures grown on MRS to $OD_{600}$=0.3 were transferred to MRS adjusted to desired pH with lactic acid. After 30 minutes cells were harvested and RNA was isolated. For carbon source utilization experiments, similar aliquots of *L. acidophilus* cultures were grown on semi-synthetic medium (Barrangou et al. (2003) *Proc. Natl. Acad. Sci. U.S.A.* 100:8957-8963) supplemented with select sugars to $OD_{600}$=0.6. Total RNA was isolated by using Trizol (Gibco/BRL), following the supplier's instructions.

cDNA Probe Preparation and Microarray Hybridization

Identical amounts (25 μg) of total RNA were aminoallyl-labeled by reverse transcription with random hexamers in the presence of amino-allyl dUTP (Sigma Chemical Co.), using Superscript II reverse transcriptase (Life Technologies) at 42° C. overnight, followed by fluorescence-labeling of aminoallylated cDNA with N-hydroxysuccinimide-activated Cy3 or Cy5 esters (Amersham Pharmacia Biotech). Labeled cDNA probes were purified using the PCR Purification Kit (Qiagen). Coupling of the Cy3 and Cy5 dyes to the AA-dUTP labeled cDNA and hybridization of samples to microarrays were performed according to the protocols outlined in the TIGR protocols website. Briefly, combined Cy5- and Cy3-labeled cDNA probes were hybridized to the arrays for 16 hours at 42° C. After hybridization, the arrays were washed in low stringency buffer (1×SSC containing 0.2% SDS), high stringency buffer (0.1×SSC containing 0.2% SDS) and finally in 0.1×SSC.

Data Normalization and Gene Expression Analysis

Immediately after washing of the arrays, fluorescence intensities were acquired using a General Scanning Scan Array 4000 Microarray Scanner (Packard Biochip Bioscience, Biochip Technologies LLC, Mass.) and processed as TIFF images. Signal intensities were quantified using the Quant Array 3.0 software package (Packard Bioscience). Two slides (each containing triplicate arrays) were hybridized reciprocally to Cy3- and Cy5-labeled probes per experiment (dye swap). Spots were analyzed by adaptive quantization. The local background was subtracted, subsequently, from the recorded spot intensities. Data was normalized against the median. When the local background intensity was higher than the spot signal (negative values), no data was considered for those spots. The median of the six ratios per gene was recorded. The ratio between the average absolute pixel values for the replicated spots of each gene with and without treatment represented the fold change in gene expression. All genes belonging to a potential operon were considered if at least one gene of the operon showed significant expression changes. Confidence intervals and P values on the fold change were also calculated with the use of a two-sample t test. P values of 0.05 or less were considered significant. For carbohydrate experiments, data were processed according to a mixed-model of ANOVA (Wolfing et al. (2001) *J. Compute. Biol.* 8:625-637).

Example 3

PFAM Results for Amino Acid Sequences

Table 6 shows the top PFAM results for the amino acid sequences of the invention.

Example 4

Identification and Inactivation of Genetic Loci Involved with *Lactobacillus acidophilus* Acid Tolerance The analysis of the complete *L. acidophilus* NCFM genome sequence enabled the identification of genes potentially involved in decarboxylation-antiporter reactions within the genome. In this study, four open reading frames (ORFs) were investigated for their contribution to overall acid tolerance of this probiotic bacterium.

Strains and plasmids. The bacterial strains and plasmids used in this study are listed in Table 7. *E. coli* was propagated at 37° C. in Luria-Bertani (Disco Laboratories Inc., Detroit, Mich.) broth with shaking. When appropriate, *E. coli* cultures were propagated or selected on brain heart infusion agar (Disco) supplemented with 150 μg of erythromycin/ml. *Lactobacilli* were propagated statically at 37° C. in MRS broth (Disco) or on MRS agar supplemented with 1.5% agar. When appropriate, erythromycin (5.0 μg/ml) or/and chloramphenicol was added to MRS broth or agar plates.

Standard DNA techniques. Total *Lactobacillus* DNA was isolated as described in Walker and Klaenhammer (1994) *J. Bacteriol.* 176:53305340. Standard protocols were used for ligations, endonuclease restrictions, DNA modification, and transformation as described by Sambrook et al. (Sambrook et al. 1989. Molecular cloning: a laboratory manual, 2nd ed. Cold Spring Harbor Laboratory Press, Cold Spring Harbor, N.Y.). Plasmid DNA from *E. coli* was isolated using the QIAprep spin kit according to the manufacturer's instructions (QIAGEN Inc., Valencia, Calif.). PCR was performed according to standard protocols (Innis et al. 1990. PCR protocols. A guide to methods and applications. Academic Press, San Diego, Calif.). Southern hybridization of genomic DNA was performed using the Roche Molecular Biochemicals DIG nonradioactive nucleic acid labeling and detection system according to the manufacturer's specifications at 42° C. in the standard hybridization buffer (containing 50% formamide). Detection of hybridization was performed with a CSPD chemiluminescent substrate.

Generation ofsite-specific integrations in *L. acidophilis*. An internal fragment of each ORF targeted for inactivation was amplified using *L. acidophilus* NCFM chromosomal DNA as template. The corresponding primers used are listed in Table 8. Internal fragments were cloned in the integrative vector pORI28 (Law et al. (1995) *J. Bacteriol.* 177:7011-7018) and introduced by electroporation into *L. acidophilus* NCFM containing pTRK669 (Russell and Klaenhammer (2001) *Appl. Environ. Microbiol.* 67:4361-4364). Subsequent steps were carried out according to the protocol described by Russell and Klaenhammer, 2001, supra. The position of the plasmid insertion within suspected integrants was confirmed by both PCR and Southern hybridization analysis to identify junction fragments.

Survival of stationary- and logarithmic-phase cultures in acid. To establish the acid sensitivity of stationary-phase cultures, cells were propagated in MRS at 37° C. for 16 hours. Four milliliters of cells were then centrifuged and resuspended in the same volume of MRS acidified to pH values ranging from 2.7 to 4.0, with lactic acid concentrations ranging from 220 to 1,520 mM. Survival was determined at 30-min intervals by serial dilutions in 10% MRS and enumeration on MRS agar using a Whitley Automatic Spiral Plater (Don Whitley Scientific Limited, West Yorkshire, England). Specific numbers of deaths per hour (K) were calculated by plotting the natural logarithm of survivors over time. The mean of four values was calculated for each sample at each interval, and K was calculated as the slope of the death curve.

To determine the acid sensitivity of log-phase cells, cultures were grown to an optical density at 600 nm (OD600) of 0.25 to 0.3 (pH>5.8) from a 2% inoculum in MRS broth. Cultures were centrifuged and resuspended in the same volume of MRS adjusted to pH 3.5 with lactic acid (at a concentration of 320 mM). Survival was determined at 30- or 40-min intervals by plating on MRS.

Acid adaptation assay. Cultures were propagated to an OD600 of 0.25 to 0.3 (pH>5.8). Cells were then centrifuged and resuspended in the same volume of MRS, pH 5.5 (adjusted with lactate or HCl), and were then incubated for 1 h at 37° C. Controls were resuspended in MRS at pH 6.8. The cells were centrifuged again and subsequently resuspended in fresh MRS at pH 3.5 (adjusted with lactic acid) or pH 3.0 (adjusted with HCl). Samples were taken at 30-min intervals and were plated on MRS agar.

Bile, salt, ethanol, and heat stress assays. Adapted (pH 5.5 for 1 hour, adjusted with lactate) and nonadapted log-phase cells (OD600=0.3) were centrifuged and resuspended in the same volume of MRS for heat stress (55° C.) or in MRS containing 5% (wt/vol) bile (Oxgall; Difco), 10% (wt/vol) NaCl, or 20% (vol/vol) ethanol. Survival for each treatment was determined after 2 hours by serial dilutions in 10% MRS and enumeration on MRS agar.

Computational analysis. BLASTP 2.2.7 (Altschul et al. (1997) *Nucleic Acids Res.* 25:3389-3402) was used to align sequences. Protein conserved domains were defined based on Pfam and COG (Clusters of Orthologous Groups) collections of conserved patterns. Functional assignments for potential target genes were determined manually. TMHMM was used to predict transmembrane helices in proteins.

Nucleotide sequence accession numbers. The nucleotide sequences of *L. acidophilus* NCFM ORF 57 (SEQ ID NO:1), ORF 867 (SEQ ID NO:51), ORF 995 (SEQ ID NOS:59, 315), and ORF 996 (SEQ ID NO:61) have been deposited in the GenBank database under the accession numbers AY542887, AY542888, AY542889, and AY542890, respectively.

Tolerance of *L. acidophilus* to Acid

To evaluate the resistance of *L. acidophilus* NCFM to acid, log-phase cells of NCK1398, a lacL integrant used as a parental control for these experiments (Russell and Klaenhammer, 2001, supra), were exposed to pH 3.0 (adjusted with HCl) (see FIG. 1). No loss of viability was detected over 5 hours of exposure to pH 3.0, indicating a naturally high level of acid resistance in *L. acidophilus* to hydrochloric acid. In contrast, exposure of NCK1398 to lactic acid (pH 3.5) eliminated more than 90% of the population within 2.5 hours. When these cells were first exposed to pH 5.5 for 1 hour and then were challenged by exposure to pH 3.5 (lactate), only a minor loss of viability was observed (see FIG. 1). The data indicate that *L. acidophilus* induces an adaptive response at pH 5.5 that provides elevated acid tolerance to the cells.

Figure 2:
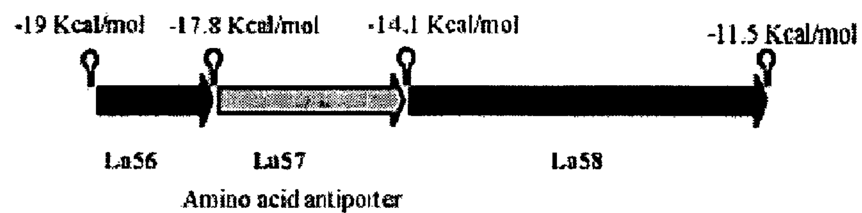
FIGS. 2A-C show acid stress-related genes in *L. acidophilus*.
Figure 2:
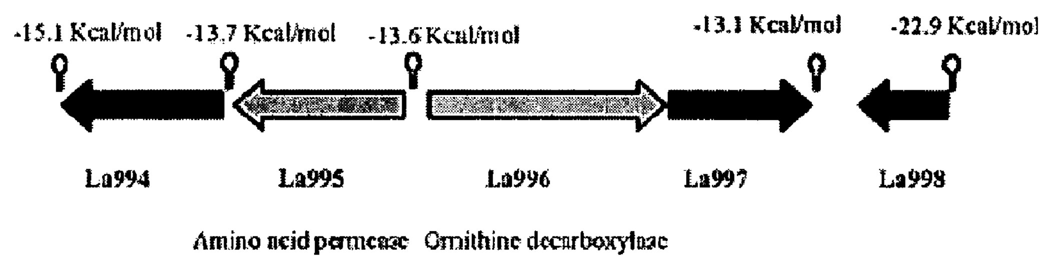
Figure 2:
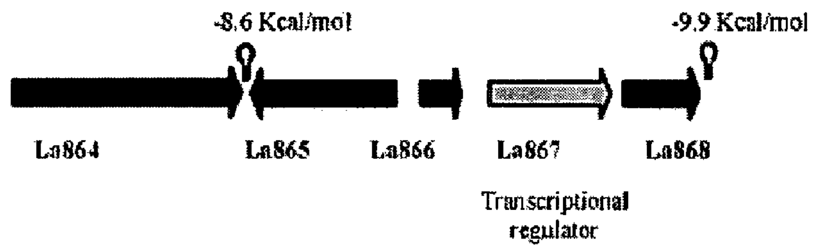

Sequence Analysis of Regions Implicated in Acid Tolerance and Generation of Site-specific Integrations Three regions in the *L. acidophilus* genome carrying putative genes were identified that were suspected to provide acid tolerance to NCFM via amino acid decarboxylation. First, a gene similar to an ornithine decarboxylase (ORF 996; COG1982) (SEQ ID NO:61) was identified. Additionally, 12 ORFs were identified that contained a conserved amino acid permease module, COG0513. Among these, an amino acid antiporter (ORF 57) (SEQ ID NO:1) was selected, and the amino acid permease (ORF 995) (SEQ ID NOS:59, 315), which was located adjacent to the ornithine decarboxylase (ORF 996) (SEQ ID NO:61). Finally, a transcriptional regulator (ORF 867) (SEQ ID NO:51) showing weak similarity to GadR, the regulator of the GadBC system in *L. lactis* (Nomura et al. (1999) *Microbiology* 145:1375-1380), was selected. The annotations of these four genes and their surrounding regions are shown in FIG. 2.

Amino Acid Antiporter

No genes with high similarities to glutamate decarboxylase genes were found in the NCFM genome sequence. The putative protein encoded by ORF 57 (SEQ ID NO:1) showed high identity (37 and 35%) with and similarity (60 and 58%) to a glutamate γ-aminobutyrate antiporter, designated gadC, in *Clostridium perfringens* (Shimizu et al. (2002) *Proc. Natl. Acad. Sci. U.S.A.* 99:996-1001) and *L. lactis* (Bolotin et al. (2001) *Genome Res.* 11:731-753), respectively (see FIG. 2A). In *L. lactis*, gadCB forms an operon present in one copy in the chromosome (Nomura et al. (1999) *Microbiology* 145:1375-1380). ORF 57 (SEQ ID NO:1) also shares similarity with the glutamate and glutamate γ-aminobutyrate antiporters in *Listeria* innocua, *L. monocytogenes, S. flexneri*, and *E. coli*. In *L. acidophilus* the antiporter is flanked by two terminators and is located downstream of a putative exodeoxyribonuclease and upstream of a putative helicase. An amino acid permease-conserved domain (pfam00324) was found in ORF 57 (SEQ ID NO:1), but a key motif that is predicted to play a role in the recognition of glutamate (FHLVFFLLLGG) (SEQ ID NO:377) was absent (Waterman and Small (1996) *Mol. Microbiol.* 21:925-940). The absence of the conserved motif necessary for glutamate recognition in ORF 57 (SEQ ID NO:1) indicates that this gene is not likely to encode an antiporter for glutamate.

Figure 3:
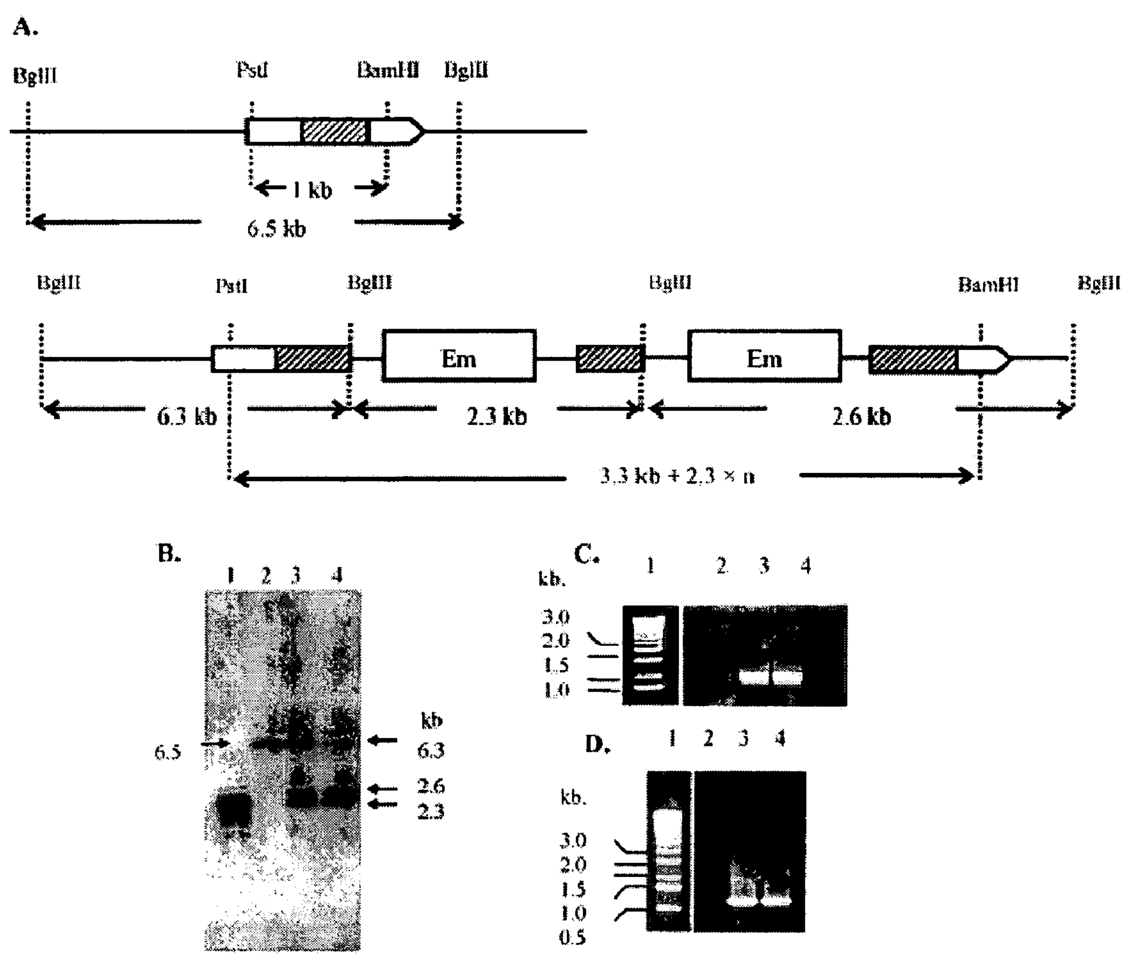
FIGS. 3A-D show the insertional inactivation of ORF 57 (SEQ ID NO:1) in *L. acidophilus* NCFM.

To determine if ORF 57 (SEQ ID NO:1) contributed to acid tolerance in *L. acidophilus* NCFM, the gene was insertionally inactivated. A 576-bp internal region was amplified by PCR (see Table 8). This fragment was then cloned into pORI28, and the resulting plasmid was transferred by electroporation into *L. acidophilus* NCK1392, which is NCFM harboring pTRK669. The integration strategy was carried out as described by Russell and Klaenhammer, 2001, supra, and putative integrants were selected. Disruption of ORF 57 (SEQ ID NO:1) was confirmed by both PCR analysis and Southern hybridization to detect junction fragments (see FIG. 3). The mutant with the disruption of ORF 57 (SEQ ID NO:1) was designated NCK1678.

Ornithine/arginine/lysine Decarboxylase and Amino Acid Permease

ORF 995 (SEQ ID NOS:59, 315)(see FIG. 2B) was similar to that of a permease from the amine-polyamine-choline superfamily. Polyamines (putrescine, spermidine, and spermine) are necessary for survival in *E. coli*, and they result from amino acid decarboxylation events (Silla (1996) *Int. J. Food Microbiol.* 29:213-231). As mentioned above, a module related to amino acid transport (COG0531) is highly conserved within the protein sequence. In addition, ORF 995 (SEQ ID NOS:59, 315) shows 12 strong transmembrane segments, suggesting that the N terminus is located in the cytoplasm. One of the most conserved bacterial members of this family is PotE, in *E. coli*. PotE is a 46-kDa protein that also contains 12 transmembrane segments, linked by hydrophilic segments of various lengths with the N and C termini, both located in the cytoplasm. Together with the gene encoding an inducible ornithine decarboxylase (speF), potE constitutes an operon in *E. coli*. Interestingly, the excretion of putrescine is catalyzed by the putrescine/ornithine antiporter activity of PotE (Igarashi and Kashiwagi (1999) *Biochem. J.* 344:633-642).

ORF 996 (SEQ ID NO:61)(see FIG. 2B) showed 48% identity (64% similarity) with the ornithine decarboxylase (EC 4.1.1.17) from *Lactobacillus* sp. strain 30a (Hackert et al. (1994) *J. Bacteriol.* 176:7391-7394), a representative of the large, pyridoxal-5'-phosphate (PLP)-dependent decarboxylases that act on lysine, arginine, or ornithine. This enzyme decarboxylates ornithine to putrescine and $CO_2$. Two major conserved domains are present in ORF 996 (SEQ ID NO:61): the Orn/Lys/Arg decarboxylase major domain (pfam 0127.4) and the Orn/Lys/Arg decarboxylase C terminal domain (pfam 03711.2).

Transcriptional Regulator

ORF 867 (SEQ ID NO:51) encodes a 267-amino acid putative positive transcriptional regulator (see FIG. 2C). It contains the conserved helix-turn-helix domain present in the XRE family-like proteins (smart00530.4). ORF 867 (SEQ ID NO:51) has low similarity (22% identity) to the positive regulator GadR in *L. lactis*, part of the gadCB operon (Sanders et al. (1998) *Mol Microbiol.* 27:299-310). In *L. lactis*, gadR is located upstream of gadCB and encodes a protein of 276 residues, similar to Rgg, a positive regulator involved in the expression of glucosyltransferase in *Streptococcus gordonii* (Sulavik and Clewell (1996) *J. Bacteriol.* 178:5826-5830). The presence of the helix-turn-helix motif and the similarity to a transcriptional regulator involved in acid tolerance in *L. lactis* led us to choose this gene for insertional inactivation. To investigate the possible involvement of the selected target genes in acid tolerance, mutants were constructed by homologous integration events. A 624-bp internal region of the ornithine decarboxylase gene (ORF 996) (SEQ ID NO:61), a 604-bp internal fragment of the amino acid permease gene (ORF 995) (SEQ ID NOS:59, 315), and a 593-bp internal fragment of the transcriptional regulator gene (ORF 867) (SEQ ID NO:51) were amplified by PCR using the primer sets ORF 996 (SEQ ID NO:61), ORF 995 (SEQ ID NOS:59, 315), and ORF 867 (SEQ ID NO51) respectively (see Table 6). Integration events were confirmed by both PCR experiments and Southern hybridizations. Mutants with disruptions of ORF 867 (SEQ ID NO:51) (transcriptional regulator), ORF 995 (SEQ ID NOS:59, 315) (amino acid permease), and ORF 996 (SEQ ID NO:61) (ornithine decarboxylase) were designated NCK1680, NCK1684, and NCK1682, respectively. All the integrants were genetically stable when propagated in the presence of antibiotic. However, after 40 generations in the absence of antibiotic selection, instability of the insertions detected by loss of antibiotic resistance occurred at frequencies ranging from 25% for NCFMΔlacL to 90 to 99% for the other four insertional mutants.

Acid Challenge and Adaptation Assays

Figure 4:
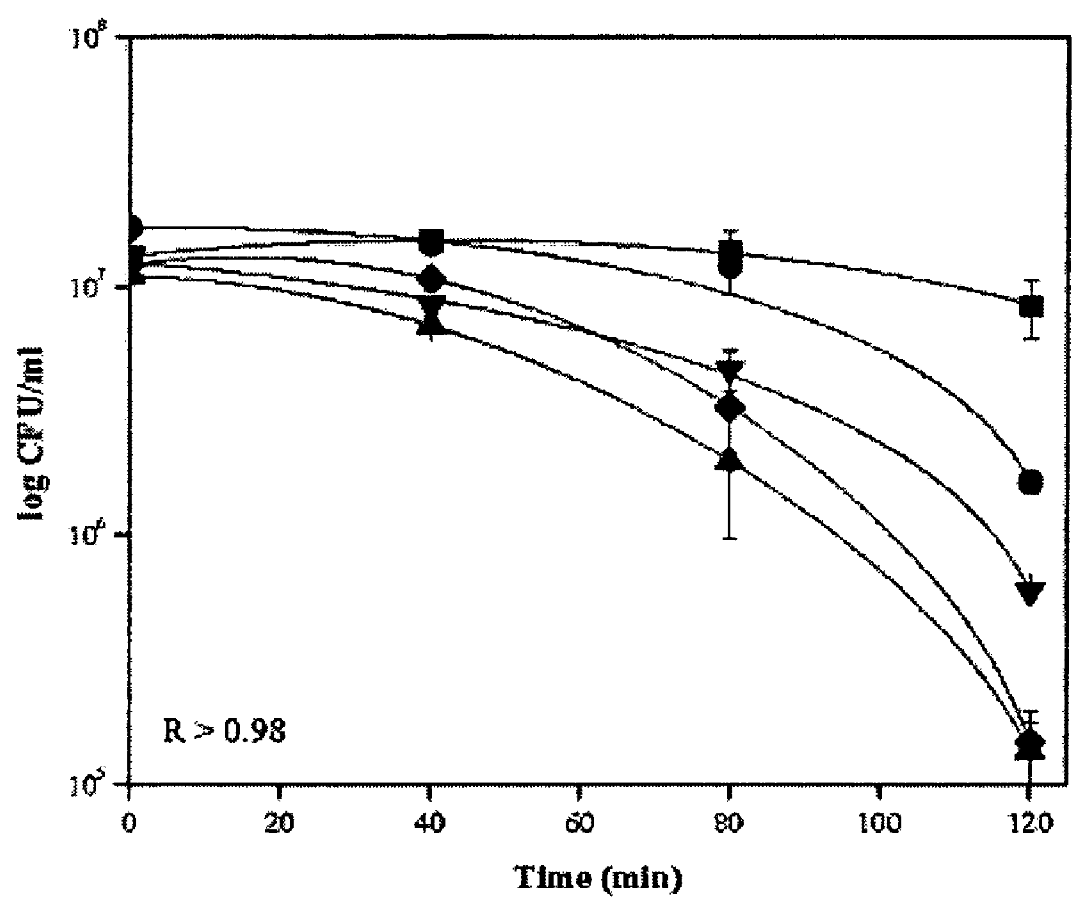
FIG. 4 shows survival of log-phase *L. acidophilus* cultures in MRS adjusted to pH 3.5 with lactic acid. Viable cell counts were performed at 40-min intervals. □, NCK1398 (control); ●, NCK1678 (ORF 57 (SEQ ID NO:1), amino acid antiporter); ▲, NCK1680 (ORF 867 (SEQ ID NO:51), transcriptional regulator); ♦, NCK1682 (ORF 995 (SEQ ID NOS:59 and 315), amino acid permease); ▼, NCK1684 (ORF 996 (SEQ ID NO:61), ornithine decarboxylase).
Figure 5:
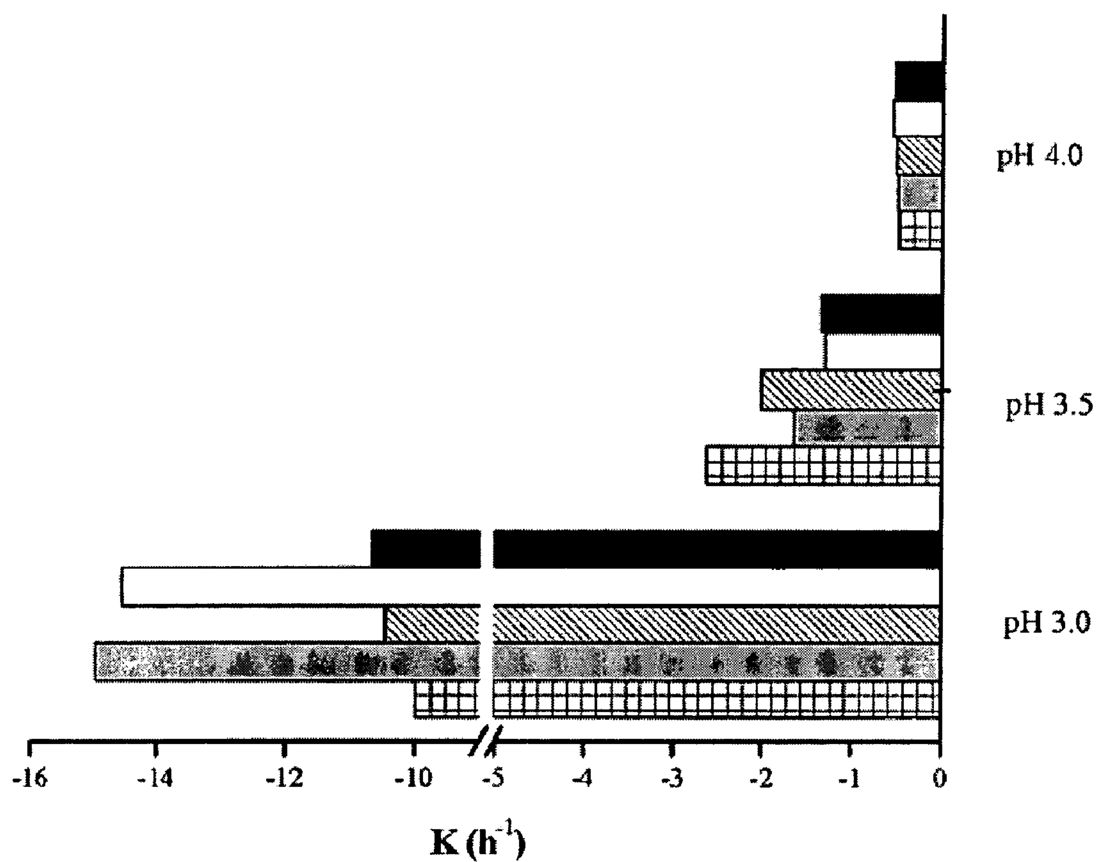
FIG. 5 shows the specific death rate (K) of late-stationary-phase cells of *L. acidophilus* after exposure to pH 3.0, 3.5, and 4.0, adjusted with lactic acid. Viable cell counts were performed at 30-min intervals. ■, *L. acidophilus* NCK1398 (control); □, NCK1678 (ORF 57 (SEQ ID NO:1), amino acid antiporter); hatched bars, NCK1680 (ORF 867 (SEQ ID NO:51), transcriptional regulator); grey bars, NCK1684 (ORF 996 (SEQ ID NO:61), ornithine decarboxylase); crossed bars, NCK1682 (ORF 995 (SEQ ID NOS:59 and 315), amino acid permease).
Figure 6:
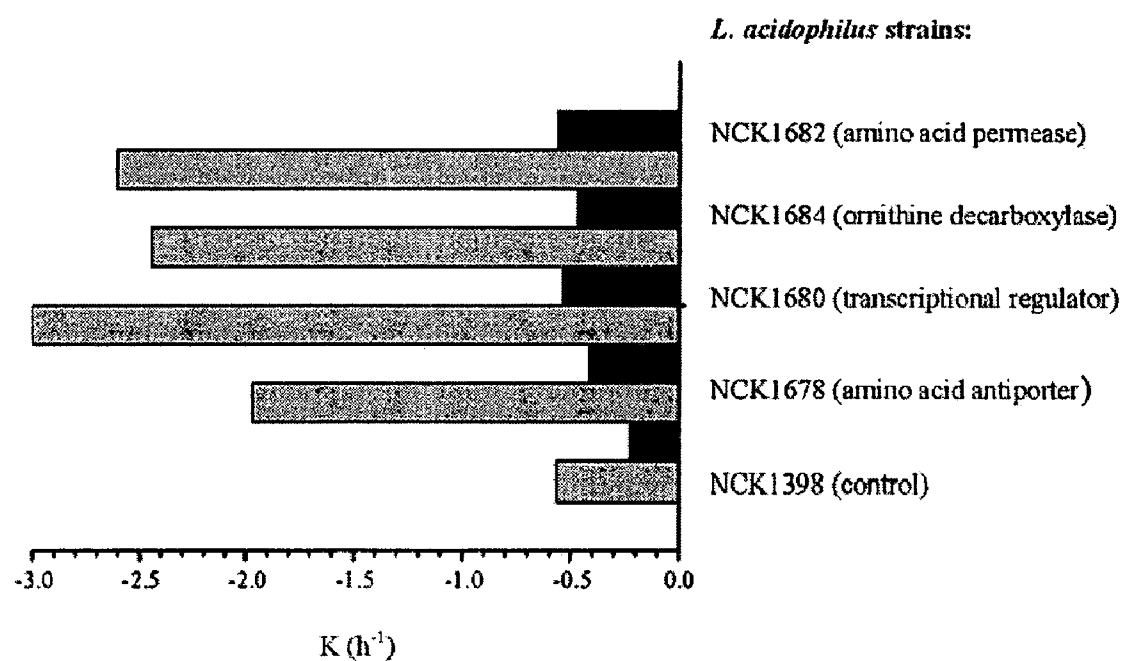
FIG. 6 shows the specific death rates (K) of nonadapted (shaded bars) and adapted (solid bars) log-phase cells of *L. acidophilus* derivatives after challenge at pH 3.5 (adjusted with lactic acid). Cells were adapted at pH 5.5 for 1 hour prior to exposure to pH 3.5. Correlation values (R) were >0.9. Viable cell counts were performed at 30-minute intervals for 2.5 hours.

The response of log and stationary-phase cells to a lethal pH was investigated and was used for comparisons of the mutants and wild-type cultures. A derivative of *L. acidophilus* NCFM designated NCK1398, where the lacL gene encoding α-galactosidase was inactivated (Russell and Klaenhammer, 2001, supra), was used as the wild-type control in the acid tolerance experiments so that antibiotic pressure could be maintained on all strains. In MRS broth cultures, all mutants showed growth rates similar to that of the control at initial pH values of 6.8 or 5.5 (adjusted with either lactic acid or hydrochloric acid). Early-log-phase cells were exposed to MRS broth adjusted to pH 3.5 with lactic acid (see FIG. 4). All the mutants showed significant differences in specific death rate compared to that of the control. Major differences were observed in NCK1684 (ornithine decarboxylase) (SEQ ID NOS:59, 315) and NCK1680 (transcriptional regulator) (SEQ ID NO:51), where the K value for both mutants was 4.8 times higher than that of the control. The K values for NCK1682 (SEQ ID NO:61) and NCK1678 (SEQ ID NO:1) were 3.6 and 2.3 times higher, respectively, than the specific death rate of NCK1398. These data suggested that these genes are involved in acid tolerance in *L. acidophilus*. Stationary-phase cells sampled from cultures grown for 16 hours were exposed to MRS adjusted to pH 3.0, 3.5, or 4.0 with lactate (see FIG. 5). No growth or loss of viability was observed for the control or any of the mutants at pH 4.0 over a 2-h incubation period. At pH 3.5, slightly higher K values were observed for NCK1682 (SEQ ID NO:61) and NCK1680 (SEQ ID NO:51). At pH 3.0, a higher specific death rate was observed for the mutants disrupted in the antiporter (NCK1678) (SEQ ID NO:1) and ornithine decarboxylase (NCK1684) (SEQ ID NOS:59, 315). The correlation values (R) for the specific death rates were >0.9 at pHs 3.5 and 3.0 and >0.8 at pH 4.0. Lastly, log-phase cells were resuspended in fresh MRS broth at pH 5.5 for 1 h prior to challenge at pH 3.5 (see FIG. 6). The control (parental cells) showed little effect and remained fairly tolerant to treatment at pH 3.5 ($K=-0.24$ in the nonadapted cells versus $K=-0.55$ in the adapted cells). In contrast, all four mutants, which were markedly sensitive at pH 3.5 (see FIG. 4), showed virtually no acid sensitivity following a 1-hour treatment at pH 5.5. The results indicate that treatment at pH 5.5 resulted in adapted cells that were more tolerant to acid challenge. Moreover, the adaptation completely overcame the acid sensitivity of the mutants generated by each of the individual genes inactivated.

Trehalose Metabolism and Cryoprotection

Figure 7:
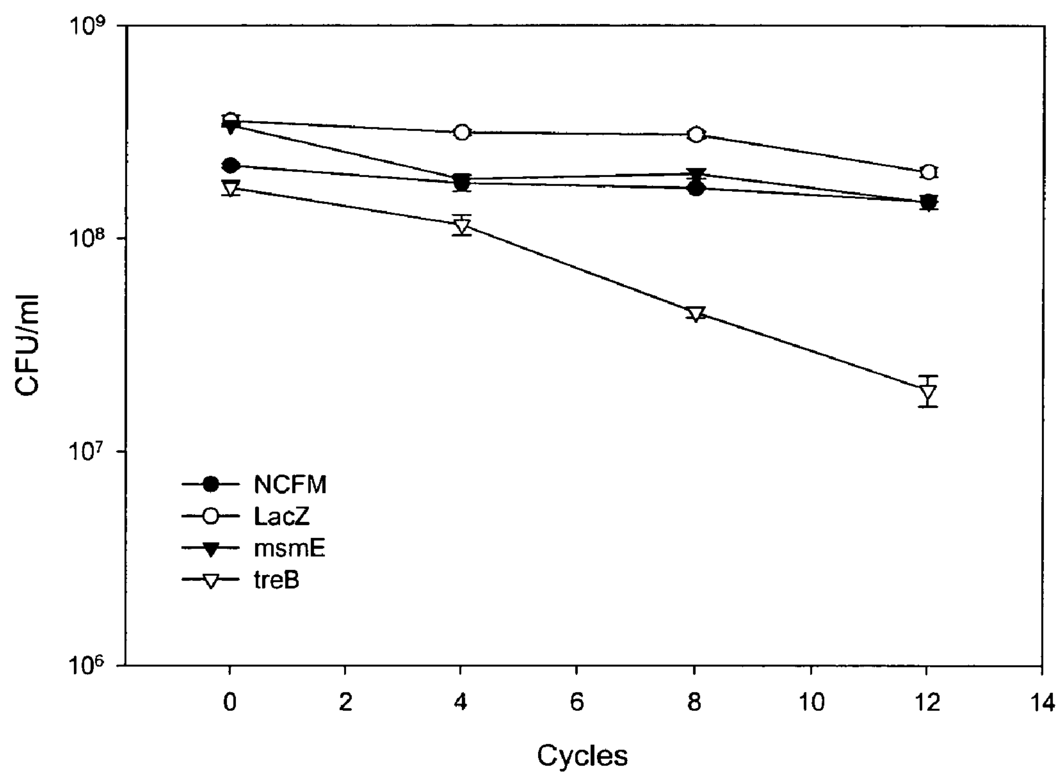
FIG. 7 shows NCFM mutant survival from cryogenic stress. Genes inactivated by targeted plasmid insertion are as indicated (lacZ, msmE, treB) and compared to wild-type (NCFM). Cultures were grown to an optical density of 0.5 at 600 nm in SSM buffer containing 0.5% fructose. Cells were harvested and resuspended in 20% trehalose in Butterfield's buffer and subjected to successive freeze-thaw cycles (−70° C., 5 min; 20° C. 10 min). Cell recovery was measured as CFU/ml.

Freezing and lyophilization are common methods used for preservation and storage of microorganisms during the production of concentrated starter cultures destined for industrial fermentations. The disaccharide trehalose has physical and chemical properties that have been reported to protect bacterial, yeast and animal cells against a variety of environmental stresses, including cryogenic stress. In addition to being metabolized as a primary carbohydrate, trehalose has been shown to confer cryoprotection upon *L. acidophilus*. Analysis of the *L. acidophilus* genome revealed a putative trehalose utilization and catabolism locus (tre) locus (ORFs 1012, 1013, 1014) that encode a transcriptional regulator of the lacI family, a trehalose specific Enzyme II typical of phosphotransferase systems (PTS), and a trehalose-6-phosphate hydrolase. Genome wide transcriptional analysis using whole genome microarrays was performed on RNA samples isolated from cells grown on several carbohydrates. This analysis revealed gene expression was induced by trehalose but repressed by glucose in a manner consistent with carbon catabolite repression, likely, through cre-like sequences found in the promoter-operator region. Targeted plasmid insertion was used to inactivate the genes encoding the PTS transporter and the hydrolase. The ability of both mutants to grow on trehalose was abolished. Additionally, inactivation of the PTS transporter was found to dramatically reduce the ability of trehalose to protect *L. acidophilus* from cryogenic stress (FIG. 7), indicating that the intracellular accumulation of trehalose is required for optimal cryoprotection.

Responses to Other Stress Conditions

Many organisms respond to challenging environments by synthesizing a collection of stress proteins that may confer general protection against a variety of stressors. We examined the response of the four acid-sensitive mutants to different stress conditions. The response of log-phase cells to stress was investigated by exposing nonadapted and adapted (in MRS at pH 5.5, adjusted with lactate, for 1 hour) cells to bile (5%, wt/vol), sodium chloride (10%, wt/vol), high temperature (55° C.), and ethanol (20%, vol/vol). Cells were exposed to the different stress conditions for 2 hours and then were plated on MRS. For nonadapted cultures, cells of *L. acidophilus* NCK1680 (transcriptional regulator) (SEQ ID NO:51) and NCK1682 (amino acid permease) (SEQ ID NO:61) were more sensitive to 5% bile (1.9 and 0.5% survival, respectively) than was the control strain (17.7% survival). Interestingly, nonadapted cells of NCK1684 (ornithine decarboxylase) (SEQ ID NOS:59, 315) were more resistant to 5% bile than the control strain (61.6% versus 17.7% survival in the control). No significant differences in survival were observed for nonadapted cells exposed to 10% NaCl, and all survived at levels of 60% after 2 hours. Nonadapted mutant strains were more sensitive to heat stress than NCK1398, because no colonies were detected after 2 hours at 55° C. Different degrees of sensitivity to ethanol stress were observed, NCK1682 (amino acid permease) (SEQ ID NO:61) being the most sensitive (0.028% versus 52.4% survival in the control). Preconditioning of strains with acid did not induce ethanol, bile, or heat tolerance. However, acid-adapted strains of *L. acidophilus* NCK1398 (control), NCK1680 (transcriptional regulator) (SEQ ID NO:51), and NCK1684 (ornithine decarboxylase) (SEQ ID NOS:59, 315) displayed higher resistance to 10% NaCl (nonadapted cells survived at a level of 70%, and adapted cells survived at levels higher than 99%).

In this study, four ORFs with similarities to genes involved in amino acid decarboxylation reactions in other microorganisms were identified from the genomic sequence of *L. acidophilus*. The selected genes were insertionally inactivated, and the acid sensitivities of the derivatives were compared to that of a control strain. The ability of the mutants to mount an adaptation response to acid was also investigated. It was found that all four selected genes, namely, an amino acid antiporter, an ornithine decarboxylase, an amino acid permease, and a transcriptional regulator, contributed to the acid tolerance of *L. acidophilus*. However, over and above the contribution of these individual genes, an acid adaptation response was orchestrated by exposure to pH 5.5 for 1 hour. This adaptation provided full acid protection to the organism upon challenge at pH 3.5 and overcame any deficiencies resulting from the loss of each of the four individual genes involved in amino acid decarboxylation reactions.

*L. acidophilus* exhibits an acid tolerance response that enables cells pre-exposed to mildly acidic conditions (pH 5.5) to better survive more severe acid challenges (pH 4.0) than cells that were not pre-exposed (Lorca et al. (2002) *J. Mol. Microbiol Biotechnol.* 4:525-532). Acid tolerance response involves the induction of acid shock genes and depends on several regulatory systems. In this study, we demonstrated that the inactivation of selected genes affecting acid sensitivity did not affect the capability of *L. acidophilus* to adapt to a highly acid-tolerant state.

In this study, acid-adapted cells exhibited higher resistance to NaCl than nonadapted cells, suggesting that partial physiological protection from acid and salt may overlap. When the amino acid permease encoded by ORF 995 (SEQ ID NOS:59, 315) was inactivated, high sensitivity to bile was observed in the mutant strain. The inactivation of the ornithine decarboxylase (ORF 996) (SEQ ID NO:61) gene, adjacent to the ORF 995 (SEQ ID NOS:59, 315) gene (but on the complementary strand), produces higher resistance to bile. In contrast, interruption of the amino acid permease (ORF 995, SEQ ID NOS:59, 315) results in bile sensitivity.

Four stress-related genes in *L. acidophilus* involved in acid and additional stresses are identified herein. This study elucidated some of the mechanisms underlying the ability of *L. acidophilus* to survive low-pH environments, an important and desirable characteristic of probiotic cultures.

Bile Salt Hydrolysis Activity

Construction of bsh mutants. The directed integration system described previously by Russell and Klaenhammer (2001) was used to first inactivate bshA (SEQ ID NO:367), and then bshB (SEQ ID NO:369) in the genome of *L. acidophilus* NCFM, creating two separate mutants. Primers were designed to amplify a 588 bp internal region of bshA (F-5'-aaa <u>gtcgac</u> gaa aag ggg ctt ggt a-3' (SEQ ID NO:378); R-5'-aa <u>gaattcc</u> cat cag gtt gtt cta c-3' (SEQ ID NO:379)). The underlined restriction sites were used to clone the amplified product into the $Ori^+$ $RepA^-$ integration plasmid, pORI28. The resultant plasmid, pTRK734, was transformed into *L. acidophilus* NCFM containing pTRK669, a temperature-sensitive helper plasmid that provides repA in trans for the replication of pORI28. A temperature increase from 37° C. to 42° C. resulted in the integration of pTRK734 into the NCFM genome, concurrent with the loss of pTRK669 and its associated CmR phenotype at the non-permissive temperature. To confirm the integration of pTRK734 at the correct genome locus, Southern hybridizations were performed using the 588 bp fragment, labeled with non-radioactive DIG (Roche Diagnostics Corporation, Indianapolis, Ind.), as a probe. The bshA probe hybridized to a 4.8 kb EcoRI fragment in the wild-type. In the mutant, NCK1618, this band was absent and due to the presence of a single EcoRI site in the integration vector sequence, junction fragments of approximately 4.3 kb and 2.7 kb were observed, indicating the occurrence of a single crossover homologous recombination event. In the case of bshB, a 618 bp internal fragment was amplified (F-5'-agg atc cag tta gtt cca tca gaa ta-3' (SEQ ID NO:380); R-5'-tat aag ctt ggt atg gcc gga ctc aac-3' (SEQ ID NO:381)), cloned into pORI28 to create pTRK735, and a similar strategy adopted for inactivation.

Detection of BSH activity. A direct plate assay for detection of BSH activity was employed to compare the bshA and bshB mutants with the wild-type strain. A number of glycine- and taurine-conjugated bile salts were selected for the assays;

as listed in Table 9. By including bile salts in agar medium, BSH-positive strains can be identified by halos of precipitated free bile acids surrounding the colonies due to hydrolysis and acidification of the medium. The assay used in this study is a modified version of that developed by Dashkevicz and Feighner; in the present assays, the concentration of bile salts was reduced from 0.5% to 0.2% due to the inability of *L. acidophilus* NCFM to grow at 0.5%. In the case of taurochenodeoxycholic acid (TCDCA) and glycochenodeoxycholic acid (GCDCA), this concentration was reduced further to 0.05%. For the wild-type strain, hydrolysis of taurodeoxycholic acid (TDCA) and taurocholic acid (TCA) under anaerobic conditions resulted in significant amounts of deoxycholic acid precipitating around active colonies. Similar levels of precipitation were observed surrounding colonies of NCK1618 (AbshA mutant) when plated on TDCA and TCA, indicating that this mutant had retained the ability to hydrolyze these deoxy-conjugated compounds. Furthermore, NCK1618 retained the ability to hydrolyze the glycine-conjugated compounds such as glycodeoxycholic acid (GDCA) and glycocholic acid (GCA). Hydrolysis of TCDCA and GCDCA by *L. acidophilus* NCFM was observed as "cloudiness" in the agar, rather than as distinct zones of precipitation observed for the other bile salts.

However, while both the parent and mutant grew, albeit slowly, on 0.05% TCDCA and GCDCA, NCK1618 appeared to have lost the ability to hydrolyze both salts (Table 2), as indicated by the lack of precipitation in the agar. When both TCDCA and GCDCA concentrations in the agar were further reduced to 0.02%, the ΔbshA mutant showed signs of BSH activity, comparable to that of the parent. Creation of a ΔbshB (NCK1619) mutant allowed the activities of BshB to be assessed in a similar manner. Comparisons with the parent strain demonstrated that while NCK1619 displayed growth on and precipitation of all glyco-conjugates tested, this mutant was capable of growth, but incapable of precipitation of the tauro-conjugated bile salts, TCA, TDCA and 0.02% TCDCA. At 0.05% TCDCA, growth of NCK1619 was notably absent.

Thus to summarize, while NCK1618 (ΔbshA) was capable of the hydrolysis of some tauro- and glyco-conjugated bile salt, this mutant had reduced ability to hydrolyze TCDCA and GCDCA, bile salts containing chenodeoxycholic acid as the steroid moiety. Conversely, inactivation of bshB revealed that the BshB enzyme encoded by this gene appears to exhibit substrate specificity dictated by the amino acid conjugated to the bile salt. This conclusion was made based on the inability of NCK1619 to hydrolyze any bile salt conjugated to taurine.

All publications, patents and patent applications mentioned in the specification are indicative of the level of those skilled in the art to which this invention pertains. All publications, patents and patent applications are herein incorporated by reference to the same extent as if each individual publication, patent or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

TABLE 1

Genes Induced by Environmental Stress in LAB

| Stress | Gene | Function of protein | Organisms | References |
|---|---|---|---|---|
| Heat | groEL | chaperone | *Lb. johnsonii* | (Walker et al., 1999) |
| | | | *Lb. acidophilus* | (Girgis et al., 1999; Girgis et al., 2000) |
| | | | *L. lactis* | (Kim and Batt, 1993, Hartke et al., 1997) |
| | | | *E. faecalis* | (Flahaut et al., 1997) |
| | | | *Lc. mesenteroides* | (Salotra et al., 1995) |
| | | | *Lb. helveticus* | (Broadbent et al., 1998) |
| | groES | chaperone | *Lb. johnsonii* | (Walker et al., 1999) |
| | | | *Lb. acidophilus* | (Girgis et al., 1999; Girgis et al., 2000) |
| | | | *L. lactis* | (Kim and Batt, 1993; Hartke et al., 1997) |
| | | | *Lb. helveticus* | (Broadbent et al., 1998) |
| | HrcA | heat shock regulator | *S. mutans* | (Jayaraman et al., 1997) |
| | | | *Lb. sakei* | (Schmidt et al., 1999) |
| | | | *Lb. acidophilus* | (Girgis et al., 2000) |
| | | | *L. lactis* | (Eaton et al., 1993) |
| | dnaK | chaperone | *L. lactis* | (Eaton et al., 1993; Barril et al., 1994) |
| | | | *S. mutans* | (Jayaraman et al., 1997) |
| | | | *E. faecalis* | (Flahaut et al., 1997) |
| | | | *Lc. mesenteroides* | (Salotra et al., 1995) |
| | | | *Lb. sakei* | (Schmidt et al., 1999) |
| | | | *Lb. acidophilus* | (Girgis et al., 2000) |
| | grpE | chaperone | *L. lactis* | (Eaton et al., 1993) |
| | | | *S. mutans* | (Jayaraman et al., 1997) |
| | | | *Lb. sakei* | (Schmidt et al., 1999) |
| | | | *Lb. acidophilus* | (Girgis et al., 2000) |
| | dnaJ | chaperone | *L. lactis* | (van Asseldonk et al., 1993) |
| | | | *Lb. sakei* | (Schmidt et al., 1999) |
| | ctsR | heat shock regulator | *L. lactis* | (Derre et al., 1999) |
| | | | *S. salivarius* | (Derre et al., 1999) |
| | | | *S. pneumoniae* | (Derre et al., 1999) |
| | | | *S. pyogenes* | (Derre et al., 1999) |
| | | | *S. thermophilus* | (Derre et al., 1999) |

TABLE 1-continued

Genes Induced by Environmental Stress in LAB

| Stress | Gene | Function of protein | Organisms | References |
|---|---|---|---|---|
| | | | *E. faecalis* | (Derre et al., 1999) |
| | | | *Lc. oenos* | (Derre et al., 1999) |
| | | | *Lb. sake* | (Derre et al., 1999) |
| | clpB | protease | *L. lactis* | (Ingmer et al., 1999) |
| | clpC | protease | *L. lactis* | (Ingmer et al., 1999) |
| | | | *Lb. acidophilus* | (Girgis et al., 2000) |
| | clpE | protease | *L. lactis* | (Ingmer et al., 1999) |
| | | | *Lb. acidophilus* | (Girgis et al., 2000) |
| | | | *Lb. sake* | (Stentz et al., 1997) |
| | clpX | chaperone/protease | *O. oeni* | (Jobin et al., 1999) |
| | clpP | protease | *L. lactis* | (Frees and Ingmer, 1999) |
| | | | *S. salivarius* | (Giffard et al., 1993) |
| | ftsH | heat shock regulator | *L. lactis* | (Nilsson et al., 1994) |
| | hsp18 | membrane maintenance | *O. oeni* | (Jobin et al., 1997) |
| Cold | cspA | RNA stabilization | *L. lactis* | (Wouters et al., 1998) |
| | cspB | RNA stabilization | *L. lactis* | (Chapot-Chartier et al., 1997; Wouters et al., 1998) |
| | cspC | RNA stabilization | *L. lactis* | (Wouters et al., 1998) |
| | cspD | RNA stabilization | *L. lactis* | (Wouters et al., 1998) |
| | cspE | | *L. lactis* | (Wouters et al., 1998) |
| | cspF | | *L. lactis* | (Wouters et al., 2000) |
| | cspG | | *L. lactis* | (Repine et al,. 1981) |
| | cspL | RNA stabilization | *Lb. plantarum* | (Mayo et al., 1997) |
| | cspP | RNA stabilization | *Lb. plantarum* | (Mayo et al., 1997) |
| Acid | gadCB | acid stress protection | *L. lactis* | (Sanders et al., 1998; Small and Waterman, 1998) |
| | citP | acid stress protection | *L. lactis* | (Garcia-Quintans et al., 1998) |
| | atp | acid stress protection | *Lb. acidophilus* | (Kullen and Klaenhammer, 1999) |
| | arcABCTD | acid stress protection | *Lb. sake* | (Zuniga et al., 1998) |
| Oxidative | sodA | $O_2^-$ scavenging | *L. lactis* | (Poyart et al., 1995; Sanders et al., 1995) |
| | | | *E. faecalis* | (Poyart et al., 1995) |
| | | | *E. faecium* | (Poyart et al., 1995) |
| | | | *S. agalactiae* | (Poyart et al., 1995) |
| | | | *S. pneumoniae* | (Poyart et al., 1995) |
| | | | *S. pyogenes* | (Poyart et al., 1995) |
| | | | *S. mutans* | (Nakayama, 1992) |
| | recA | DNA repair | *L. lactis* | (Duwat et al., 1995) |
| | | | *Lb. bulgaricus* | (Duwat et al., 1992) |
| | | | *Lb. helveticus* | (Duwat et al., 1992) |
| | | | *Lc. mesanteroides* | (Duwat et al., 1992) |
| | | | *S. salivarus* | (Duwat et al., 1992) |
| | fpg | DNA repair | *L. lactis* | (Duwat et al., 1992; Duwat et al., 1995) |
| | fnr | $O_2^-$ scavenging | *L. lactis* | (Gostick et al., 1999) |
| | nox | $H_2O_2$ reducing | *S. mutans* | (Higuchi, 1992; Matsumoto et al., 1996; Higuchi et al., 1999) |
| | | | *S. pneumoniae* | (Auzat, 1999) |
| | | | *Lb. delbreuckii* | (Marty-Teysset, et al. 2000) |
| | npr | $H_2O_2$ reducing | *E. faecalis* | (Ross and Claiborne, 1991; Ross and Claiborne, 1992) |
| | katA | $H_2O_2$ reducing | *Lb. sake* | (Knauf et al., 1992) |
| | gor | $H_2O_2$ reducing | *S. thermophilus* | (Pébay et al., 1995) |
| | | | *S. mutans* | (Yamamoto et al., 1999) |
| | | | *Lb. acidophilus* | (Girgis et al., 2000) |
| | trxA | $H_2O_2$ reducing | *O. oeni* | (Jobin et al., 1999) |
| Osmotic | htrA | stress protection | *Lb. helveticus* | (Smeds et al., 1998) |

TABLE 2

Stress-Related Proteins of the Present Invention

| SEQ ID NO: | ORF NO. | FUNCTION | COG |
|---|---|---|---|
| 1, 2 | 57 | GadC - Glutamate:gamma aminobutyrate antiporter | 0531 |
| 3, 4 | 83 | Serine protease HtrA | 0265 |

TABLE 2-continued

Stress-Related Proteins of the Present Invention

| SEQ ID NO: | ORF NO. | FUNCTION | COG |
|---|---|---|---|
| 5, 6 | 96 | HtpX - protease | 0501 |
| 7, 8 | 115 | TerC family protein - ortholog of stress response protein | 0861 |

TABLE 2-continued

Stress-Related Proteins of the Present Invention

| SEQ ID NO: | ORF NO. | FUNCTION | COG |
|---|---|---|---|
| 9, 10 | 119 | Cardiolipin synthase | 1502 |
| 11, 12 | 175 | S-layer protein | |
| 13, 14 | 205 | Heat shock protein | 0071 |
| 15, 16 | 232 | RNA polymerase | 3343 |
| 17, 18 | 278 | FtsH - Cell division protein | 0465 |
| 19, 20 | 283 | ClpC - class III stress response related ATPase | 0542 |
| 21, 22 | 279 | HSP 33 homologue - 33 kDa chaperonin | 1281 |
| 23, 24 | 414 | DNA-damage inducible protein P | 0389 |
| 25, 26 | 351 | Sigma factor | 1595 |
| 27, 28 | 405 | GroES - Cochaperonin | 0234 |
| 29, 30 | 406 | GroEL - 60 kDa chaperonin | 0459 |
| 31, 32 | 431 | PepRI - regulator with identity to CcpA | 1609 |
| 33, 34 | 439 | Thioredoxin reductase | |
| 35, 36 | 676 | HprK - bifunctional HPr kinase | 1493 |
| 37, 38 | 679 | Thioredoxin reductase - general stress protein | 0492 |
| 39, 40 | 694 | ClpP - ATP-dependent protease/proteolytic subunit | 0740 |
| 41, 42 | 698 | Glyceraldehyde-3-phosphate dehydrogenase | 0057 |
| 43, 44 | 783 | Universal stress protein | 0589 |
| 45, 46 | 833 | FtsW - Cell division protein | 0772 |
| 47, 48 | 847 | ClpX - ATP-dependent protease/ATP-binding subunit | 1219 |
| 49, 50 | 851 | LysA - Diaminopimelate decarboxylase | 0019 |
| 51, 52 | 867 | Transcriptional regulator | 1396 |
| 53, 54 | 932 | RelA - ppGpp synthetase/involved in starvation response | 0317 |
| 55, 56 | 984 | HslV - ATP-dependent protease | 5405 |
| 57, 58 | 985 | HslU/HtpO - heat-shock induced protein | 1220 |
| 59, 60 | 995 | Amino acid permease | 0531 |
| 61, 62 | 996 | Ornithine decarboxylase | 1982 |
| 63, 64 | 1012 | Beta-glucoside specific PTS system | 1263 |
| 65, 66 | 1013 | Trehalose operon transcriptional repressor | 2188 |
| 67, 68 | 1014 | Trehalose 6-P hydrolase | 0366 |
| 69, 70 | 1047 | Thiol peroxidase/superoxide-inducible protein 8 | 2077 |
| 71, 72 | 1107 | Glutathione reductase | 1249 |
| 73, 74 | 1203 | Phosphate starvation-inducible protein | 1702 |
| 75, 76 | 1237 | MetA - Homoserine O-succinyltransferase | 1897 |
| 77, 78 | 1246 | DnaJ chaperone protein | 0484 |
| 79, 80 | 1247 | DnaK - Heat shock protein 70 | 0443 |
| 81, 82 | 1248 | GrpE - Cochaperonin/HSP-70 co-factor | 0576 |
| 83, 84 | 1249 | HrcA - Heat-inducible transcriptional repressor | 1420 |
| 85, 86 | 1254 | Ribosome binding factor A | 0858 |
| 87, 88 | 1255 | Translation initiation factor | 0532 |
| 89, 90 | 1256 | Ribosomal protein | 1358 |
| 91, 92 | 1259 | N-utilization substance protein A | 0195 |
| 93, 94 | 1260 | Stress-related protein | 0779 |
| 95, 96 | 1261 | DNA polymerase III | 2176 |
| 97, 98 | 1262 | Prolyl tRNA synthetase | 0442 |
| 99, 100 | 1263 | Eep - determinant for enhanced expression of pheromone | 0750 |
| 101, 102 | 1264 | Eep - determinant for enhanced expression of pheromone | |
| 103, 104 | 1265 | Phosphatidate cytidylyltransferase | 0575 |
| 105, 106 | 1282 | Uracyl DNA glycosylase | 1573 |
| 107, 108 | 1283 | Glycosyl transferase | 0463 |
| 109, 110 | 1284 | Cell division protein FtsI/penicillin-binding protein | 0768 |
| 111, 112 | 1285 | Membrane protein (gtrA) | 2246 |
| 113, 114 | 1286 | 50S ribosomal protein | 0335 |
| 115, 116 | 1287 | tRNA methyltransferase | 0336 |
| 117, 118 | 1288 | 16S rRNA processing protein | 0806 |
| 119, 120 | 1289 | 30S ribosomal protein | 0228 |
| 121, 122 | 1290 | Signal recognition particle protein | 0541 |
| 123, 124 | 1291 | Amino acid transporter | 0531 |
| 125, 126 | 1292 | Amino acid transporter | |
| 127, 128 | 1293 | Transcriptional regulator/MarR, EmrR family | 1846 |
| 129, 130 | 1294 | Dipeptidase | 4690 |
| 131, 132 | 1295 | FtsY - Cell division protein | 0552 |
| 133, 134 | 1296 | Chromosome segregation SMC protein | 1196 |
| 135, 136 | 1297 | Ribonuclease III | 0571 |
| 137, 138 | 1311 | Alkaline shock protein | 1302 |
| 139, 140 | 1374 | Heavy metal stress response protein | 0229 |
| 141, 142 | 1401 | NADH peroxidase | 0446 |
| 143, 144 | 1513 | Low temperature requirement protein | 4292 |
| 145, 146 | 1524 | LisK - histidine kinase | 0642 |
| 147, 148 | 1525 | LisR - response regulator | 0745 |
| 149, 150 | 1578 | Serine protease | 0265 |
| 151, 152 | 1793 | Stress-related protein | |
| 153, 154 | 1898 | Thioredoxin reductase | 0492 |
| 155, 156 | 1901 | Thioredoxin | 0526 |
| 157, 158 | 1910 | ClpE-ATP-dependent protease/ATP-binding subunit | 0542 |
| 159, 160 | 697 | Transcriptional regulator | 2390 |
| 161, 162 | 889 | 2-phosphoglycerate dehydratase | 0148 |
| 163, 164 | 845 | ef-tu | 0050 |
| 165, 166 | 958 | Stress-related protein | 2996 |
| 167, 168 | 778 | ATP synthase beta subunit | 0055 |
| 169, 170 | 169 | S-layer slpA | |
| 171, 172 | 600 | Xylulose-5-phosphate/fructose phosphoketolase | 3957 |
| 173, 174 | 1469 | UDP-glucose 4-epimerase | 1087 |
| 175, 176 | 776 | ATP synthase alpha subunit | 0056 |
| 177, 178 | 772 | H+-transporting ATP synthase chain a | 0356 |
| 179, 180 | 970 | DNA-binding protein II HB | 0776 |
| 181, 182 | 752 | Glucose-6-phosphate isomerase | 0166 |
| 183, 184 | 640 | p-enolpyruvate-protein p-transferase pt1 | 1080 |
| 185, 186 | 699 | Phosphoglycerate kinase | 0126 |
| 187, 188 | 656 | Permease | 0628 |
| 189, 190 | 1300 | Oligopeptide ABC transporter; substrate-binding protein OppA | 0747 |
| 191, 192 | 1464 | Transposase, IS605-TnpB family | 0675 |
| 193, 194 | 271 | L-lactate dehydrogenase; L-LDH | 0039 |
| 195, 196 | 957 | Pyruvate kinase | 0469 |
| 197, 198 | 986 | Galactose mutarotase-related enzyme | 2017 |
| 199, 200 | 1196 | RNA polymerase sigma factor RpoD | 0568 |
| 201, 202 | 1870 | Maltose phosphorylase | 1554 |
| 203, 204 | 466 | Phosphoenolpyruvate carboxykinase | 1866 |
| 205, 206 | 1027 | Oxidoreductase | 0656 |
| 207, 208 | 8 | Single-stranded DNA-binding protein | 0629 |
| 209, 210 | 455 | Mannose-specific PTS system component IIC | 3715 |
| 211, 212 | 612 | Transport protein | 1253 |
| 213, 214 | 289 | Translation elongation factor ef-G | 0480 |
| 215, 216 | 777 | ATP synthase gamma subunit | 0224 |
| 217, 218 | 775 | ATP synthase delta subunit | 0712 |
| 219, 220 | 152 | ABC transporter (alkylphosphonate), ATP-binding protein | 3638 |
| 221, 222 | 1463 | Lactose permease | 2211 |
| 223, 224 | 185 | Phosphoglycerate mutase | 0588 |
| 225, 226 | 55 | D-lactate dehydrogenase | 1052 |
| 227, 228 | 774 | H+-transporting ATP synthase chain b | 0711 |
| 229, 230 | 1468 | Beta-galactosidase small subunit | 3250 |
| 231, 232 | 1459 | Galactokinase | 0153 |
| 233, 234 | 1388 | Cellobiose phosphotransferase | 3394 |

TABLE 2-continued

Stress-Related Proteins of the Present Invention

| SEQ ID NO: | ORF NO. | FUNCTION | COG |
|---|---|---|---|
| 235, 236 | 311 | Protein translocase secY | 0201 |
| 237, 238 | 1115 | Amino acid permease | 0531 |
| 239, 240 | 270 | Stress-related protein | 0517 |
| 241, 242 | 773 | H+-transporting ATP synthase C chain | 0636 |
| 243, 244 | 1467 | Beta-galactosidase large subunit (lactase) | 3250 |
| 245, 246 | 1833 | Oxidoreductase | 0431 |
| 247, 248 | 1892 | Adenylosuccinate synthase | 0104 |
| 249, 250 | 956 | Phosphofructokinase | 0205 |
| 251, 252 | 285 | RNA polymerase DNA-directed beta subunit | 0086 |
| 253, 254 | 1201 | GTP-binding protein Era | 1159 |
| 255, 256 | 284 | RNA-polymerase DNA-directed beta subunit | 0085 |
| 257, 258 | 1763 | Oligopeptidase | 1164 |
| 259, 260 | 1198 | Glycyl-tRNA synthetase beta chain | 0751 |
| 261, 262 | 916 | Citrate lyase beta chain | 2301 |
| 263, 264 | 1202 | Metal-dependent hydrolase | 0319 |
| 265, 266 | 267 | ATP-dependent RNA helicase | 0513 |
| 267, 268 | 1599 | Fructose bisphosphate aldolase | 0191 |
| 269, 270 | 935 | Histidyl tRNA synthetase | 0124 |
| 271, 272 | 786 | 30S ribosomal protein S4 | 0522 |
| 273, 274 | 716 | Phosphoglucomutase | 1109 |
| 275, 276 | 1238 | Cysteine synthase | 0031 |
| 277, 278 | 733 | Stress-related protein | 0217 |
| 279, 280 | 779 | ATP synthase epsilon subunit | 0355 |
| 281, 282 | 846 | Trigger factor cell division | 0544 |
| 283, 284 | 654 | Cation transport ATPase | 0474 |
| 285, 286 | 422 | Thioredoxin reductase | 0526 |
| 287, 288 | 1581 | Thioredoxin | 0526 |
| 289, 290 | 1418 | Oxidoreductase | 1902 |
| 291, 292 | 1421 | Oxidoreductase | 1902 |
| 293, 294 | 887 | Nitroreductase | 0778 |
| 295, 296 | 666 | recA | 0468 |
| 297, 298 | 1969 | flpA | 0664 |
| 299, 300 | 544 | Transcriptional regulator | 0664 |
| 301, 302 | 818 | Cold shock protein | 1278 |
| 303, 304 | 205 | Heat shock protein | 0071 |
| 305, 306 | 278 | FtsH Cell division protein | 0465 |
| 307, 308 | 679 | Thioredoxin reductase general stress protein 35/EC 1.6.4.5 | 0492 |
| 309, 310 | 833 | FtsW- Cell division protein | 0772 |
| 311, 312 | 851 | LysA - Diaminopimelate decarboxylase/EC 4.1.1.20 | 0019 |
| 313, 314 | 932 | RelA ppGpp synthetase/involved in starvation response/EC 2.7.6.5 | 0317 |
| 315, 316 | 995 | Amino Acid Permease | 0531 |
| 317, 318 | 1012 | Beta-glucoside specific PTS system | 1263 |
| 319, 320 | 1014 | Trehalose 6-P hydrolase | 0366 |
| 321, 322 | 1255 | Translation initiation factor | 0532 |
| 323, 324 | 1259 | N-utilization substance protein A | 0195 |
| 325, 326 | 1260 | | 0779 |
| 327, 328 | 1263 | Eep determinant for enhanced expression of pheromone | 0750 |
| 329, 330 | 1286 | 50S ribosomal protein | 0335 |
| 331, 332 | 1288 | 16S rRNA processing protein | 0806 |
| 333, 334 | 1291 | Amino acid transporter | 0531 |
| 335, 336 | 1292 | Putative amino acid transporter | |
| 337, 338 | 1294 | Dipeptidase | 4690 |
| 339, 340 | 1578 | Serine protease | 0265 |
| 341, 342 | 1898 | Thioredoxin reductase/EC 1.6.4.5 | 0492 |
| 343, 344 | 889 | 2-phosphoglycerate dehydratase | 0148 |
| 345, 346 | 845 | ef-tu | 0050 |
| 347, 348 | 600 | Xylulose-5-phosphate/fructose phosphoketolase | 3957 |
| 349, 350 | 776 | ATP synthase alpha subunit | 0056 |
| 351, 352 | 970 | DNA-binding protein II HB | 0776 |
| 353, 354 | 699 | Phosphoglycerate kinase | 0126 |
| 355, 356 | 8 | Single-stranded DNA-binding protein | 0629 |
| 357, 358 | 1468 | Beta-galactosidase small subunit | 3250 |
| 359, 360 | 1388 | Cellobiose phosphotransferase | 3394 |
| 361, 362 | 1201 | GTP-binding protein Era | 1159 |
| 363, 364 | 935 | Histidyl tRNA synthetase | 0124 |
| 365, 366 | 786 | 30S ribosomal protein S4 | 0522 |
| 367, 368 | 892 | bshA | |
| 369, 370 | 1078 | bshB | 3049 |

TABLE 3

Top Blast result for SEQ ID NOS: 284-370

| SEQ ID NO: | ORF | Percent Identity | Amino Acid Range | Organism | Description | Accession No. |
|---|---|---|---|---|---|---|
| 284 | 654 | 60 | 8 to 909 | *Oenococcus oeni* PSU-1 | COG0474: Cation transport ATPase | ref\|ZP_00319111.1 |
| 286 | 422 | 79 | 1 to 103 | *Lactobacillus johnsonii* NCC 533 | thioredoxin | ref\|NP_964506.1 |
| 288 | 1581 | 80 | 1 to 105 | *Lactobacillus johnsonii* NCC 533 | thioredoxin | ref\|NP_965472.1 |
| 290 | 1418 | 60 | 1 to 265 | *Lactobacillus johnsonii* NCC 533 | | ref\|NP_965109.1 |
| 292 | 1421 | 60 | 1 to 56 | *Lactobacillus johnsonii* NCC 533 | | ref\|NP_965110.1 |
| 294 | 887 | 55 | 2 to 159 | *Lactobacillus gasseri* | COG0778: Nitroreductase | ref\|ZP_00045913.1 |
| 296 | 666 | 85 | 1 to 360 | *Lactobacillus johnsonii* NCC 533 | RecA protein | ref\|NP_964694.1 |
| 298 | 1969 | 60 | 1 to 216 | *Lactobacillus gasseri* | COG0664: cAMP-binding proteins - catabolite gene activator and | ref\|ZP_00047192.1 |
| 300 | 544 | 97 | 1 to 211 | *Lactobacillus johnsonii* NCC 533 | | ref\|NP_965500.1 |
| 302 | 818 | 77 | 1 to 66 | *Lactobacillus johnsonii* NCC 533 | cold shock protein | ref\|NP_964836.1 |
| 304 | 205 | 62 | 1 to 141 | *Lactobacillus gasseri* | COG0071: Molecular chaperone (small heat shock protein) | ref\|ZP_00047227.2 |
| 306 | 278 | 75 | 1 to 715 | *Lactobacillus johnsonii* NCC 533 | cell division protein FtsH-like protein | ref\|NP_964299.1 |
| 308 | 679 | 70 | 1 to 306 | *Lactobacillus johnsonii* NCC 533 | thioredoxin reductase | ref\|NP_964707.1 |
| 310 | 833 | 69 | 1 to 384 | *Lactobacillus gasseri* | COG0772: Bacterial cell division membrane protein | ref\|ZP_00046289.1 |
| 312 | 851 | 61 | 10 to 430 | *Pediococcus pentosaceus* ATCC 25745 | COG0019: Diaminopimelate decarboxylase | ref\|ZP_00323380.1 |

TABLE 3-continued

Top Blast result for SEQ ID NOS: 284-370

| SEQ ID NO: | ORF | Percent Identity | Amino Acid Range | Organism | Description | Accession No. |
|---|---|---|---|---|---|---|
| 314 | 932 | 73 | 1 to 746 | *Lactobacillus gasseri* | COG0317: Guanosine polyphosphate pyrophosphohydrolases/synthetases | ref\|ZP_00046539.1 |
| 316 | 995 | 100 | 1 to 490 | *Lactobacillus acidophilus* | amino acid permease La995 | gb\|AAT09141.1 |
| 318 | 1012 | 77 | 9 to 643 | *Lactobacillus johnsonii* NCC 533 | phosphoenolpyruvate-dependent sugar phosphotransferase system | ref\|NP_964612.1 |
| 320 | 1014 | 77 | 1 to 552 | *Lactobacillus gasseri* | COG0366: Glycosidases | ref\|ZP_00045981.1 |
| 322 | 1255 | 69 | 1 to 877 | *Lactobacillus johnsonii* NCC 533 | translation initiation factor IF-2 | ref\|NP_965289.1 |
| 324 | 1259 | 81 | 1 to 389 | *Lactobacillus gasseri* | COG0195: Transcription elongation factor | ref\|ZP_00046583.2 |
| 326 | 1260 | 65 | 1 to 158 | *Lactobacillus gasseri* | COG0779 | ref\|ZP_00046584.1 |
| 328 | 1263 | 70 | 1 to 418 | *Lactobacillus gasseri* | COG0750: Predicted membrane-associated Zn-dependent proteases 1 | ref\|ZP_00046587.1 |
| 330 | 1286 | 87 | 1 to 115 | *Lactobacillus johnsonii* NCC 533 | 50S ribosomal protein L19 | ref\|NP_965314.1 |
| 332 | 1288 | 52 | 2 to 171 | *Lactobacillus johnsonii* NCC 533 | 16S rRNA processing protein RimM | ref\|NP_965316.1 |
| 334 | 1291 | 64 | 1 to 110 | *Lactobacillus johnsonii* NCC 533 | | ref\|NP_965319.1 |
| 336 | 1292 | 69 | 2 to 473 | *Staphylococcus aureus* subsp. *aureus* MRSA252 | amino acid permease family protein | ref\|YP_042023.1 |
| 338 | 1294 | 85 | 1 to 473 | *Lactobacillus gasseri* | COG4690: Dipeptidase | ref\|ZP_00047305.1 |
| 340 | 1578 | 25 | 434 to 635 | *Streptomyces avermitilis* MA-4680 | putative integral membrane protein | ref\|NP_824231.1 |
| 342 | 1898 | 63 | 2 to 307 | *Lactobacillus plantarum* WCFS1 | thioredoxin reductase (NADPH) | ref\|NP_784511.1 |
| 344 | 889 | 93 | 1 to 428 | *Lactobacillus gasseri* | COG0148: Enolase | ref\|ZP_00046557.1 |
| 346 | 845 | 91 | 1 to 396 | *Lactobacillus johnsonii* | Tuf | gb\|AAR25444.1 |
| 348 | 600 | 84 | 1 to 799 | *Lactobacillus johnsonii* NCC 533 | probable xylulose-5-phosphate/fructose-6-phosphate phosphoketolase | ref\|NP_964658.1 |
| 350 | 776 | 99 | 1 to 503 | *Lactobacillus acidophilus* | F1F0-ATPase subunit alpha | gb\|AAF22496.1 |
| 352 | 970 | 91 | 1 to 91 | *Lactobacillus johnsonii* NCC 533 | DNA-binding protein HU | ref\|NP_964948.1 |
| 354 | 699 | 93 | 1 to 403 | *Lactobacillus johnsonii* NCC 533 | phosphoglycerate kinase | ref\|NP_964728.1 |
| 356 | 8 | 74 | 1 to 172 | *Lactobacillus johnsonii* NCC 533 | single-strand binding protein | ref\|NP_964022.1 |
| 358 | 1468 | 100 | 1 to 316 | *Lactobacillus acidophilus* | BGAM_LACAC BETA-GALACTOSIDASE SMALL SUBUNIT (LACTASE) | sp\|O07685 |
| 360 | 1388 | 71 | 1 to 215 | *Lactobacillus johnsonii* NCC 533 | | ref\|NP_964921.1 |
| 362 | 1201 | 73 | 2 to 300 | *Lactobacillus johnsonii* NCC 533 | GTP-binding protein era-like protein | ref\|NP_965176.1 |
| 364 | 935 | 81 | 1 to 428 | *Lactobacillus gasseri* | COG0124: Histidyl-tRNA synthetase | ref\|ZP_00046537.1 |
| 366 | 786 | 82 | 1 to 203 | *Lactobacillus gasseri* | COG0522: Ribosomal protein S4 and related proteins | ref\|ZP_00341831.1 |
| 368 | 892 | 57 | 1 to 325 | *Lactobacillus Johnsonii* | conjugated bile salt hydrolase alpha peptide | gb\|AAG22541.1 |
| 370 | 1078 | 69 | 1 to 325 | *Lactobacillus Johnsonii* | conjugated bile salt hydrolase | ref\|NP_965003.1 |

TABLE 4

Most highly expressed genes by *Lactobacillus acidophilus* NCFM at pH 4.5

| SEQ ID NOS: | Description | Intensity | Ratio pH4.5/pH6.8 | P-values |
|---|---|---|---|---|
| 159 | Transcriptional regulator | 44129.4079 | 0.80977 | 0.000127 |
| 161; 343 | 2-phosphoglycerate dehydratase | 41923.1984 | 0.9396 | 0.45683 |
| 163; 345 | ef-tu | 41731.9826 | 0.89199 | 0.31537 |
| 165 | Stress-related protein | 39743.065 | 0.73297 | 3.31E−05 |
| 167 | ATP synthase beta subunit | 38399.1183 | 0.89449 | 0.2807 |
| 169 | S-layer slpA | 38161.751 | 0.88048 | 0.35259 |
| 281 | Trigger factor cell division | 36448.6497 | 0.6747 | 0.00254 |
| 171; 347 | Xylulose-5-phosphate/fructose phosphoketolase | 35902.6556 | 2.10581 | 0.29655 |
| 173 | UDP-glucose 4-epimerase | 35148.0402 | 4.05185 | 1.55E−03 |
| 175; 349 | ATP synthase alpha subunit | 33971.4418 | 0.88 | 0.38016 |
| 177 | H+-transporting ATP synthase chain a | 33385.3559 | 0.81584 | 0.16513 |
| 179 | DNA-binding protein II HB | 33336.1458 | 1.18777 | 0.55668 |
| 181 | Glucose-6-phosphate isomerase | 33014.2327 | 0.88311 | 0.60739 |

TABLE 4-continued

Most highly expressed genes by *Lactobacillus acidophilus* NCFM at pH 4.5

| SEQ ID NOS: | Description | Intensity | Ratio pH4.5/pH6.8 | P-values |
|---|---|---|---|---|
| 183 | p-enolpyruvate-protein p-transferase pt1 | 32917.1904 | 0.70429 | 0.02789 |
| 185; 353 | Phosphoglycerate kinase | 32748.299 | 0.78543 | 0.07696 |
| 187 | Permease | 32306.1784 | 1.28694 | 0.9324 |
| 189 | Oligopeptide ABC transporter, substrate binding protein OppA | 30840.739 | 0.95435 | 0.54771 |
| 191 | Transposase, is605-tnpb family | 30563.251 | 2.08933 | 0.40472 |
| 193 | L-LDH | 30305.5264 | 0.73113 | 0.13306 |
| 41 | Glyceraldehyde-3-p dehydrogenase | 30171.1465 | 0.84441 | 0.327 |
| 195 | Pyruvate kinase | 29779.3032 | 0.63536 | 0.00153 |
| 197 | Galactose mutarotase related enzyme | 29493.9766 | 5.73118 | 0.01975 |
| 199 | RNA polymerase sigma factor RpoD | 29305.3915 | 0.7066 | 0.16681 |
| 201 | Maltose phosphorylase | 29047.9743 | 3.88856 | 0.00407 |
| 203 | Stress-related protein | 27521.8023 | 16.62759 | 0.000086 |
| 205 | Oxidoreductase | 26937.1052 | 1.79467 | 1.60E−01 |
| 207; 355 | Single-stranded DNA-binding protein | 26430.8099 | 0.72409 | 0.21498 |
| 209 | Mannose-specific PTS system component IIC | 26069.7281 | 1.73335 | 0.48987 |
| 211 | Transport protein | 26035.9219 | 1.19338 | 0.58826 |
| 213 | Translation elongation factor ef-G | 25831.9003 | 0.54217 | 0.000279 |
| 215 | ATP synthase gamma subunit | 25745.6095 | 0.77641 | 0.09999 |
| 217 | ATP synthase delta subunit | 25739.4125 | 0.82966 | 0.28123 |
| 219 | ABC transporter (alkylphosphonate), ATP binding protein | 25702.9745 | 0.62748 | 0.1801 |
| 221 | Lactose permease | 25570.1399 | 11.18441 | 2.81E−06 |
| 223 | Phosphoglycerate mutase | 24822.3162 | 0.89271 | 0.92535 |
| 39 | ATP-dependent Clp protease P | 23706.6209 | 1.28222 | 0.45224 |
| 225 | D-lactate dehydrogenase | 23681.1377 | 1.86541 | 0.50409 |
| 227 | H+-transporting ATP synthase chain b | 23662.4395 | 0.76978 | 0.2752 |
| 229; 357 | Beta-galactosidase small subunit | 23331.0372 | 4.87959 | 0.00668 |
| 231 | Galactokinase | 22278.8609 | 5.83601 | 3.01E−03 |
| 233; 359 | Stress-related protein | 22221.9057 | 12.25256 | 0.00797 |
| 235 | Protein translocase secY | 22118.5026 | 0.80515 | 0.11305 |
| 237 | Amino acid permease | 21853.3507 | 1.33033 | 0.52782 |
| 239 | Stress-related protein | 21530.6595 | 1.55752 | 0.25509 |
| 3 | HtrA | 21441.5898 | 1.39392 | 0.41562 |
| 241 | H+-transporting ATP synthase C chain | 21133.0503 | 0.77615 | 0.38455 |
| 11 | S-layer slpB | 20947.0811 | 0.87384 | 0.63031 |
| 243 | Beta-galactosidase large subunit (lactase) | 20754.8566 | 6.79035 | 0.000256 |
| 245 | Oxidoreductase | 20558.9275 | 1.03032 | 0.80397 |
| 79 | Heat shock protein DnaK | 20491.7103 | 1.46525 | 0.79325 |

TABLE 5

Most highly expressed genes by *Lactobacillus acidophilus* NCFM at pH 5.5

| SEQ ID NOS: | Description | Intensity | Ratio pH6.8/pH5.5 | P-values |
|---|---|---|---|---|
| 159 | Transcriptional regulator | 49588.26243 | 1.07444 | 0.9171 |
| 163; 345 | ef-tu | 48480.11405 | 1.21152 | 0.41226 |
| 167 | ATP synthase beta subunit | 47373.63929 | 1.30484 | 0.59548 |
| 185; 353 | Phosphoglycerate kinase | 47284.28177 | 1.18978 | 0.46246 |
| 165 | Stress-related protein | 47219.39826 | 1.23243 | 0.61163 |
| 195 | Pyruvate kinase | 46378.47677 | 0.96229 | 0.65429 |
| 161; 343 | 2-phosphoglycerate dehydratase | 45742.78646 | 1.35167 | 0.39526 |
| 175; 349 | ATP synthase alpha subunit | 44720.89199 | 1.67279 | 0.45156 |
| 169 | S-layer slpA | 44606.99319 | 1.0143 | 0.89018 |
| 183 | p-enolpyruvate-protein p-transferase pt1 | 43872.30586 | 1.32455 | 0.49282 |
| 177 | H+-transporting ATP synthase chain a | 42563.47713 | 3.15607 | 0.12611 |
| 281 | Trigger factor cell division | 42390.06735 | 1.13972 | 0.97478 |

TABLE 5-continued

Most highly expressed genes by *Lactobacillus acidophilus* NCFM at pH 5.5

| SEQ ID NOS: | Description | Intensity | Ratio pH6.8/pH5.5 | P-values |
|---|---|---|---|---|
| 41 | Glyceraldehyde-3-p dehydrogenase | 42107.85352 | 1.6606 | 0.04632 |
| 247 | Adenylosuccinate synthase | 41461.2523 | 1.44108 | 0.27644 |
| 193 | L-LDH | 39124.0275 | 2.80194 | 0.06626 |
| 217 | ATP synthase delta subunit | 38870.99821 | 2.24648 | 0.19607 |
| 181 | Glucose-6-phosphate isomerase | 38275.82821 | 4.17893 | 0.16001 |
| 213 | Translation elongation factor ef-G | 38211.6518 | 0.83228 | 0.0424 |
| 215 | ATP synthase gamma subunit | 37921.02722 | 1.7514 | 0.19454 |
| 249 | Phosphofructokinase PFK | 36992.30001 | 1.71784 | 0.40325 |
| 73 | Phosphate starvation inducible protein PhoH family | 35580.8018 | 1.6886 | 0.62391 |
| 199 | RNA polymerase sigma factor RpoD | 34490.54729 | 1.41876 | 0.32783 |
| 227 | H+-transporting ATP synthase chain b | 33797.13421 | 2.1756 | 0.12826 |
| 189 | Oligopeptide ABC transporter, substrate binding protein OppA | 33717.21265 | 1.85829 | 0.13774 |
| 187 | Permease | 33320.41653 | 4.53001 | 0.22648 |
| 179; 351 | DNA-binding protein II HB | 32770.90406 | 2.73812 | 0.00365 |
| 251 | RNA-polymerase DNA-directed beta subunit | 30697.74774 | 0.81409 | 0.12716 |
| 253; 361 | gtp-binding protein Era | 30428.80848 | 1.09281 | 0.93735 |
| 255 | RNA-polymerase DNA-directed beta subunit | 30165.68379 | 0.93612 | 0.32266 |
| 47 | clpX | 29472.31317 | 1.30043 | 0.86946 |
| 207; 355 | Single-stranded DNA-binding protein | 29131.36635 | 1.17971 | 0.87035 |
| 257 | Oligopeptidase | 28909.46425 | 1.33874 | 0.76532 |
| 259 | Glycyl-tRNA synthetase beta chain | 28288.59045 | 1.18553 | 0.81716 |
| 241 | H+-transporting ATP synthase C chain | 28254.57261 | 3.04113 | 0.08203 |
| 223 | Phosphoglycerate mutase | 27944.14984 | 3.9891 | 0.02048 |
| 261 | Citrate lyase beta chain | 27573.2469 | 2.94483 | 0.00684 |
| 263 | Stress-related protein | 27568.02488 | 1.03559 | 0.56353 |
| 225 | D-lactate dehydrogenase | 27241.83294 | 3.65809 | 0.0051 |
| 265 | ATP-dependent RNA helicase | 27047.77018 | 0.96168 | 0.52527 |
| 219 | ABC transporter (alkylphosphonate), ATP binding protein | 26555.47145 | 1.30963 | 0.46616 |
| 11 | S-layer slpB | 25797.89266 | 1.22018 | 0.03542 |
| 267 | Fructose-bisphosphate aldolase | 25785.93438 | 2.80105 | 0.00517 |
| 235 | Protein translocase secY | 24889.38261 | 0.91363 | 0.24544 |
| 269; 363 | Histidyl-tRNA synthetase | 24885.28465 | 1.10785 | 0.72828 |
| 271; 365 | 30s ribosomal protein S4 | 24840.25099 | 1.40913 | 0.53757 |
| 273 | Phosphoglucomutase (glycolysis) | 24667.86423 | 2.22409 | 0.63162 |
| 275 | Cysteine synthase | 24546.91806 | 1.21812 | 0.72408 |
| 173 | UDP-glucose 4-epimerase | 23857.76289 | 5.56996 | 1.78E−04 |
| 277 | Stress-related protein | 23650.35671 | 4.6509 | 0.06285 |
| 279 | ATP synthase epsilon subunit | 23622.90488 | 1.4788 | 0.02309 |

TABLE 6

PFAM Results for Amino Acid Sequences

| SEQ ID NO: | ORF | Domain | Amino Acid Range, Start, Stop | Family | PFAM Accession No. | E-value |
|---|---|---|---|---|---|---|
| 2 | 57 | AA_permease | 25, 479 | Amino Acid Permease | PF00324 | 1.10E−05 |
| 4 | 83 | Trypsin | 131, 312 | Trypsin | PF00089 | 6.90E−18 |
| 4 | 83 | PDZ | 315, 408 | PDZ domain (Also known as DHR or GLGF) | PF00595 | 1.10E−10 |
| 6 | 96 | Peptidase_M48 | 85, 298 | Peptidase family M48 | PF01435 | 1.10E−11 |
| 8 | 115 | TerC | 28, 245 | Integral membrane protein TerC family | PF03741 | 1.70E−42 |
| 10 | 119 | PLDc | 214, 241; 398, 425 | Phospholipase D Active site motif | PF00614 | 5.40E−13 |
| 12 | 175 | SLAP | 1, 456 | Bacterial surface layer protein | PF03217 | 1.70E−182 |
| 14 | 205 | HSP20 | 38, 147 | Hsp20/alpha crystallin family | PF00011 | 1.30E−22 |
| 16 | 232 | RNA_pol_delta | 1, 184 | DNA-directed RNA polymerase delta subunit | PF05066 | 3.00E−46 |
| 18 | 278 | AAA | 233, 420 | ATPase family associated with various cellular activities (AAA) | PF00004 | 1.20E−97 |

TABLE 6-continued

PFAM Results for Amino Acid Sequences

| SEQ ID NO: | ORF | Domain | Amino Acid Range, Start, Stop | Family | PFAM Accession No. | E-value |
|---|---|---|---|---|---|---|
| 18 | 278 | Peptidase_M41 | 426, 631 | Peptidase family M41 | PF01434 | 1.30E−97 |
| 20 | 283 | Clp_N | 16, 68 | Clp amino terminal domain | PF02861 | 3.80E−21 |
| 20 | 283 | AAA | 213, 406 | ATPase family associated with various cellular activities (AAA) | PF00004 | 1.20E−16 |
| 22 | 279 | HSP33 | 2, 280 | Hsp33 protein | PF01430 | 2.30E−113 |
| 24 | 414 | IMS | 58, 401 | impB/mucB/samB family | PF00817 | 1.90E−81 |
| 28 | 405 | Cpn10 | 1, 94 | Chaperonin 10 Kd subunit | PF00166 | 2.30E−48 |
| 30 | 406 | Cpn60_TCP1 | 22, 523 | TCP-1/cpn60 chaperonin family | PF00118 | 4.20E−199 |
| 32 | 431 | LacI | 6, 31 | Bacterial regulatory proteins, lacI family | PF00356 | 1.90E−11 |
| 34 | 439 | Pyr_redox | 2, 263 | Pyridine nucleotide-disulfide oxidoreductase | PF00070 | 1.40E−11 |
| 36 | 676 | Hpr_kinase_C | 133, 313 | HPr Serine kinase C-terminus | PF07475 | 3.50E−86 |
| 36 | 676 | Hpr_kinase_N | 3, 132 | HPr Serine kinase N terminus | PF02603 | 7.90E−26 |
| 38 | 679 | pyr_redox | 12, 293 | Pyridine nucleotide-disulfide oxidoreductase | PF00070 | 1.60E−73 |
| 40 | 694 | CLP_protease | 11, 192 | Clp protease | PF00574 | 1.70E−123 |
| 42 | 698 | Gp_dh_C | 157, 318 | Glyceraldehyde 3-phosphate dehydrogenase, C-terminal domain | PF02800 | 9.70E−88 |
| 42 | 698 | Gp_dh_N | 3, 156 | Glyceraldehyde 3-phosphate dehydrogenase, NAD binding domain | PF00044 | 1.10E−82 |
| 44 | 783 | Usp | 4, 144 | Universal stress protein family | PF00582 | 1.50E−21 |
| 46 | 833 | FTSW_RODA_SPOVE | 29, 405 | Cell cycle protein | PF01098 | 5.10E−82 |
| 48 | 847 | AAA | 111, 362 | ATPase family associated with various cellular activities (AAA) | PF00004 | 9.20E−24 |
| 48 | 847 | zf-C4_ClpX | 13, 49 | ClpX C4-type zinc finger | PF06689 | 2.20E−21 |
| 50 | 851 | Orn_Arg_deC_N | 59, 320 | Pyridoxal-dependent decarboxylase, pyridoxal binding domain | PF02784 | 2.30E−77 |
| 50 | 851 | Orn_DAP_Arg_deC | 325, 431 | Pyridoxal-dependent decarboxylase, C-terminal sheet domain | PF00278 | 1.70E−29 |
| 54 | 932 | TGS | 394, 457 | TGS domain | PF02824 | 3.00E−31 |
| 54 | 932 | HD | 53, 152 | HD domain | PF01966 | 6.10E−13 |
| 56 | 984 | Proteasome | 1, 174 | Proteasome A-type and B-type | PF00227 | 1.00E−31 |
| 62 | 996 | OKR_DC_1 | 91, 545 | Orn/Lys/Arg decarboxylase, major domain | PF01276 | 2.40E−173 |
| 62 | 996 | OKR_DC_1_C | 553, 686 | Orn/Lys/Arg decarboxylase, C-terminal domain | PF03711 | 3.60E−52 |
| 64 | 1012 | PTS_EIIA_1 | 49, 153 | phosphoenolpyruvate-dependent sugar phosphotransferase system, EIIA 1 | PF00358 | 4.00E−45 |
| 64 | 1012 | PTS_EIIC | 301, 587 | Phosphotransferase system, EIIC | PF02378 | 1.20E−43 |
| 64 | 1012 | PTS_EIIB | 197, 231 | phosphotransferase system, EIIB | PF00367 | 2.40E−16 |
| 66 | 1013 | GntR | 5, 68 | Bacterial regulatory proteins, gntR family | PF00392 | 2.50E−15 |
| 68 | 1014 | alpha-amylase | 28, 429 | Alpha amylase, catalytic domain | PF00128 | 1.50E−110 |
| 70 | 1047 | AhpC-TSA | 19, 157 | AhpC/TSA family | PF00578 | 3.00E−17 |
| 72 | 1107 | Pyr_redox | 5, 311 | Pyridine nucleotide-disulfide oxidoreductase | PF00070 | 7.70E−72 |
| 74 | 1203 | PhoH | 109, 313 | PhoH-like protein | PF02562 | 2.10E−139 |
| 76 | 1237 | HTS | 1, 251 | Homoserine O-succinyltransferase | PF04204 | 3.70E−19 |
| 78 | 1246 | DnaJ_C | 238, 359 | DnaJ C terminal region | PF01556 | 5.20E−63 |
| 78 | 1246 | DnaJ | 5, 69 | DnaJ domain | PF00226 | 5.60E−38 |
| 78 | 1246 | DnaJ_CXXCXGXG | 141, 225 | DnaJ central domain (4 repeats) | PF00684 | 7.90E−28 |
| 80 | 1247 | HSP70 | 4, 575 | Hsp70 protein | PF00012 | 0 |
| 82 | 1248 | GrpE | 15, 194 | GrpE | PF01025 | 2.00E−57 |
| 84 | 1249 | HrcA | 103, 327 | HrcA protein C terminal domain | PF01628 | 1.30E−62 |
| 86 | 1254 | RBFA | 4, 108 | Ribosome-binding factor A | PF02033 | 1.10E−29 |
| 88 | 1255 | GTP_EFTU | 384, 551 | Elongation factor Tu GTP binding domain | PF00009 | 6.90E−58 |
| 88 | 1255 | GTP_EFTU_D2 | 562, 637 | Elongation factor Tu domain 2 | PF03144 | 4.50E−20 |
| 90 | 1256 | Ribosomal_L7Ae | 5, 96 | Ribosomal protein L7Ae/L30e/S12e/Gadd45 family | PF01248 | 6.90E−15 |
| 92 | 1259 | KH-domain | 324, 379 | KH Domain | PF00013 | 1.40E−07 |
| 94 | 1260 | DUF150 | 25, 168 | Uncharacterized BCR, YhbC family COG0779 | PF02576 | 4.60E−26 |
| 96 | 1261 | Exonuc_X-T | 420, 576 | Exonuclease | PF00929 | 1.10E−39 |
| 96 | 1261 | PHP_N | 334, 399 | PHP domain N-terminal region | PF02231 | 9.90E−27 |
| 96 | 1261 | PHP_C | 609, 745 | PHP domain C-terminal region | PF02811 | 4.10E−25 |
| 98 | 1262 | tRNA-synt_2b | 38, 192 | tRNA synthetase class II core domain (G, H, P, S and T) | PF00587 | 1.00E−45 |
| 98 | 1262 | YbaK | 250, 384 | YbaK/prolyl-tRNA synthetases associated domain | PF04073 | 3.50E−19 |
| 98 | 1262 | HGTP_anticodon | 472, 563 | Anticodon binding domain | PF03129 | 9.30E−19 |
| 104 | 1265 | CTP_transf_1 | 2, 270 | Cytidylyltransferase family | PF01148 | 1.10E−77 |
| 108 | 1283 | Glycos_transf_2 | 5, 172 | Glycosyl transferase | PF00535 | 1.40E−32 |
| 112 | 1285 | GtrA | 19, 132 | GtrA-like protein | PF04138 | 2.50E−15 |
| 114 | 1286 | Ribosomal_L19 | 31, 143 | Ribosomal protein L19 | PF01245 | 1.80E−61 |
| 116 | 1287 | tRNA_m1G_MT | 21, 226 | tRNA (Guanine-1)-methyltransferase | PF01746 | 1.60E−79 |
| 118 | 1288 | RimM | 28, 190 | RimM N-terminal domain | PF01782 | 4.10E−45 |
| 120 | 1289 | Ribosomal_S16 | 9, 67 | Ribosomal protein S16 | PF00886 | 1.90E−34 |
| 122 | 1290 | SRP54 | 100, 297 | SRP54-type protein, GTPase domain | PF00448 | 4.80E−112 |
| 122 | 1290 | SRP_SPB | 328, 427 | Signal peptide binding domain | PF02978 | 1.10E−57 |
| 122 | 1290 | SRP54_N | 3, 88 | SRP54-type protein, helical bundle domain | PF02881 | 3.80E−30 |

TABLE 6-continued

PFAM Results for Amino Acid Sequences

| SEQ ID NO: | ORF | Domain | Amino Acid Range, Start, Stop | Family | PFAM Accession No. | E-value |
|---|---|---|---|---|---|---|
| 126 | 1292 | aa_permease | 36, 486 | Amino acid permease | PF00324 | 1.40E−11 |
| 132 | 1295 | SRP54 | 226, 428 | SRP54-type protein, GTPase domain | PF00448 | 7.70E−112 |
| 132 | 1295 | SRP54_N | 127, 209 | SRP54-type protein, helical bundle domain | PF02881 | 2.20E−16 |
| 134 | 1296 | SMC_C | 9, 771, 179 | SMC family, C-terminal domain | PF02483 | 1.70E−95 |
| 134 | 1296 | SMC_N | 1, 167 | RecF/RecN/SMC N terminal domain | PF02463 | 8.60E−73 |
| 134 | 1296 | SMC_hinge | 514, 662 | SMC proteins Flexible Hinge Domain | PF06470 | 1.00E−31 |
| 136 | 1297 | Ribonuclease_3 | 46, 136 | RNase3 domain | PF00636 | 1.50E−40 |
| 136 | 1297 | dsrm | 163, 227 | Double-stranded RNA binding motif | PF00035 | 3.60E−15 |
| 138 | 1311 | DUF322 | 8, 116 | Protein of unknown function (DUF322) | PF03780 | 6.40E−42 |
| 140 | 1374 | SelR | 8, 129 | SelR domain | PF01641 | 5.40E−76 |
| 142 | 1401 | Pyr_redox | 5, 294 | Pyridine nucleotide-disulfide oxidoreductase | PF00070 | 2.10E−65 |
| 144 | 1513 | LtrA | 49, 95 | Bacterial low temperature requirement A protein (LtrA) | PF06772 | 6.90E−11 |
| 146 | 1524 | HATPase_c | 391, 502 | Histidine kinase−, DNA gyrase B−, and HSP90−like ATPase | PF02518 | 1.00E−33 |
| 146 | 1524 | HisKA | 278, 345 | His Kinase A (phosphoacceptor) domain | PF00512 | 5.60E−20 |
| 146 | 1524 | HAMP | 203, 274 | HAMP domain | PF00672 | 1.30E−13 |
| 148 | 1525 | Response_reg | 2, 120 | Response regulator receiver domain | PF00072 | 9.00E−35 |
| 148 | 1525 | Trans_reg_C | 155, 230 | Transcriptional regulatory protein, C terminal | PF00486 | 9.80E−22 |
| 154 | 1898 | pyr_redox | 16, 299 | Pyridine nucleotide-disulfide oxidoreductase | PF00070 | 3.60E−72 |
| 158 | 1910 | AAA | 102, 297 | ATPase family associated with various cellular activities (AAA) | PF00004 | 9.80E−21 |
| 160 | 697 | Sugar-bind | 89, 341 | Putative sugar-binding domain | PF04198 | 2.30E−75 |
| 162 | 889 | enolase_C | 10, 427 | Enolase, C-terminal TIM barrel domain | PF00113 | 2.20E−199 |
| 164 | 845 | GTP_EFTU | 20, 214 | Elongation factor Tu GTP binding domain | PF00009 | 7.10E−99 |
| 164 | 845 | GTP_EFTU_D3 | 309, 404 | Elongation factor Tu C-terminal domain | PF03143 | 4.30E−58 |
| 164 | 845 | GTP_EFTU_D2 | 226, 305 | Elongation factor Tu domain 2 | PF03144 | 1.40E−26 |
| 168 | 778 | ATP-synt_ab | 175, 352 | ATP synthase alpha/beta family, nucleotide-binding domain | PF00006 | 1.60E−85 |
| 168 | 778 | ATP-synt_ab_C | 359, 466 | ATP synthase alpha/beta chain, C terminal domain | PF00306 | 1.80E−48 |
| 168 | 778 | ATP-synt_ab_N | 6, 75 | ATP synthase alpha/beta family, beta-barrel domain | PF02874 | 1.60E−27 |
| 170 | 169 | SLAP | 1, 443 | Bacterial surface layer protein | PF03217 | 0 |
| 174 | 1469 | Epimerase | 3, 324 | NAD dependent epimerase/dehydratase family | PF01370 | 2.00E−142 |
| 174 | 1469 | 3Beta_HSD | 2, 324 | 3-beta hydroxysteroid dehydrogenase/isomerase family | PF01073 | 1.00E−07 |
| 176 | 776 | ATP-synt_ab | 98, 373 | ATP synthase alpha/beta family, nucleotide-binding domain | PF00006 | 1.10E−151 |
| 176 | 776 | ATP-synt_ab_C | 375, 483 | ATP synthase alpha/beta chain, C terminal domain | PF00306 | 6.50E−40 |
| 176 | 776 | ATP-synt_ab_N | 27, 95 | ATP synthase alpha/beta family, beta-barrel domain | PF02874 | 4.60E−18 |
| 178 | 772 | ATP-synt_A | 72, 232 | ATP synthase A chain | PF00119 | 1.00E−40 |
| 180 | 970 | Bac_DNA_binding | 6, 95 | Bacterial DNA-binding protein | PF00216 | 1.80E−51 |
| 182 | 752 | PGI | 7, 442 | Phosphoglucose isomerase | PF00342 | 3.80E−136 |
| 184 | 640 | PEP-utilizers_C | 252, 544 | PEP-utilizing enzyme, TIM barrel domain | PF02896 | 8.30E−182 |
| 184 | 640 | PEP-utilizers_N | 5, 129 | PEP-utilizing enzyme, N-terminal | PF05524 | 3.50E−57 |
| 184 | 640 | PEP-utilizers | 146, 227 | PEP-utilizing enzyme, mobile domain | PF00391 | 4.60E−37 |
| 186 | 699 | PGK | 4, 408 | Phosphoglycerate kinase | PF00162 | 7.70E−219 |
| 188 | 656 | UPF0118 | 32, 367 | Domain of unknown function DUF20 | PF01594 | 1.60E−82 |
| 190 | 1300 | SBP_bac_5 | 12, 583 | Bacterial extracellular solute-binding proteins, family 5 Middle | PF00496 | 3.50E−54 |
| 192 | 1464 | Transposase_2 | 6, 290 | Probable transposase | PF01385 | 1.00E−24 |
| 192 | 1464 | Transposase_35 | 302, 383 | Putative transposase DNA-binding domain | PF07282 | 1.50E−19 |
| 194 | 271 | Ldh_1_N | 8, 147 | lactate/malate dehydrogenase, NAD binding domain | PF00056 | 9.40E−76 |
| 194 | 271 | Ldh_1_C | 149, 317 | lactate/malate dehydrogenase, alpha/beta C-terminal domain | PF02866 | 2.00E−75 |
| 196 | 957 | PK | 1, 346 | Pyruvate kinase, barrel domain | PF00224 | 4.30E−228 |
| 196 | 957 | PK_C | 360, 475 | Pyruvate kinase, alpha/beta domain | PF02887 | 2.20E−64 |
| 196 | 957 | PEP-utilizers | 490, 579 | PEP-utilizing enzyme, mobile domain | PF00391 | 2.50E−32 |
| 198 | 986 | Aldose_epim | 2, 290 | Aldose 1-epimerase | PF01263 | 4.80E−17 |
| 200 | 1196 | Sigma70_r3 | 197, 279 | Sigma-70 region 3 | PF04539 | 5.50E−44 |
| 200 | 1196 | Sigma70_r2 | 123, 193 | Sigma-70 region 2 | PF04542 | 2.90E−28 |
| 200 | 1196 | Sigma70_r4 | 291, 344 | Sigma-70, region 4 | PF04545 | 2.90E−24 |
| 200 | 1196 | Sigma70_r1_2 | 84, 120 | Sigma-70 factor, region 1.2 | PF00140 | 4.90E−21 |
| 202 | 1870 | Glyco_hydro_65m | 320, 692 | Glycosyl hydrolase family 65 central catalytic domain | PF03632 | 4.10E−203 |
| 202 | 1870 | Glyco_hydro_65N | 11, 266 | Glycosyl hydrolase family 65, N-terminal domain | PF03636 | 1.90E−86 |
| 202 | 1870 | Glyco_hydro_65C | 696, 748 | Glycosyl hydrolase family 65, C-terminal domain | PF03633 | 1.10E−15 |

TABLE 6-continued

PFAM Results for Amino Acid Sequences

| SEQ ID NO: | ORF | Domain | Amino Acid Range, Start, Stop | Family | PFAM Accession No. | E-value |
|---|---|---|---|---|---|---|
| 206 | 1027 | Aldo_ket_red | 12, 272 | Aldo/keto reductase family | PF00248 | 1.10E−116 |
| 208 | 8 | SSB | 6, 108 | Single-strand binding protein family | PF00436 | 1.70E−50 |
| 210 | 455 | EII-Sor | 1, 238 | PTS system sorbose-specific iic component | PF03609 | 8.00E−124 |
| 212 | 612 | DUF21 | 8, 208 | Domain of unknown function DUF21 | PF01595 | 5.80E−55 |
| 212 | 612 | CBS | 227, 282; 290, 343 | CBS domain | PF00571 | 6.60E−21 |
| 214 | 289 | GTP_EFTU | 10, 285 | Elongation factor Tu GTP binding domain | PF00009 | 1.50E−112 |
| 214 | 289 | EFG_IV | 480, 599 | Elongation factor G, domain IV | PF03764 | 6.40E−69 |
| 214 | 289 | EFG_C | 601, 688 | Elongation factor G C-terminus | PF00679 | 2.20E−46 |
| 214 | 289 | GTP_EFTU_D2 | 325, 392 | Elongation factor Tu domain 2 | PF03144 | 6.40E−15 |
| 216 | 777 | ATP-synt | 3, 319 | ATP synthase | PF00231 | 1.50E−104 |
| 218 | 775 | OSCP | 8, 178 | ATP synthase delta (OSCP) subunit | PF00213 | 8.30E−55 |
| 220 | 152 | ABC_tran | 33, 227 | ABC transporter | PF00005 | 1.60E−51 |
| 222 | 1463 | PTS_EIIA_1 | 516, 608 | phosphoenolpyruvate-dependent sugar phosphotransferase system, EIIA 1 | PF00358 | 2.10E−28 |
| 224 | 185 | PGAM | 2, 226 | Phosphoglycerate mutase family | PF00300 | 4.60E−117 |
| 226 | 55 | 2-Hacid_dh_C | 119, 309 | D-isomer specific 2-hydroxyacid dehydrogenase, NAD binding domain | PF02826 | 1.70E−100 |
| 226 | 55 | 2-Hacid_dh | 16, 113 | D-isomer specific 2-hydroxyacid dehydrogenase, catalytic domain | PF00389 | 1.50E−23 |
| 228 | 774 | ATP-synt_B | 17, 148 | ATP synthase B/B' CF(0) | PF00430 | 1.30E−29 |
| 230 | 1468 | Bgal_small_N | 20, 213 | Beta galactosidase small chain, N terminal domain | PF02929 | 8.90E−94 |
| 230 | 1468 | Bgal_small_C | 222, 331 | Beta galactosidase small chain, C terminal domain | PF02930 | 5.20E−61 |
| 232 | 1459 | GHMP_kinases | 112, 351 | GHMP kinases putative ATP-binding protein | PF00288 | 2.00E−50 |
| 236 | 311 | SecY | 68, 416 | eubacterial secY protein | PF00344 | 2.10E−153 |
| 238 | 1115 | AA_permease | 15, 438 | Amino acid permease | PF00324 | 9.80E−07 |
| 242 | 773 | ATP-synt_C | 8, 77 | ATP synthase subunit C | PF00137 | 3.60E−25 |
| 244 | 1467 | Glyco_hydro_2_C | 333, 628 | Glycosyl hydrolases family 2, TIM barrel domain | PF02836 | 2.60E−146 |
| 244 | 1467 | Glyco_hydro_2_N | 39, 227 | Glycosyl hydrolases family 2, sugar binding domain | PF02837 | 2.00E−86 |
| 244 | 1467 | Glyco_hydro_2 | 229, 331 | Glycosyl hydrolases family 2, immunoglobulin-like beta-sandwich domain | PF00703 | 2.90E−21 |
| 246 | 1833 | FMN_red | 1, 168 | NADPH-dependent FMN reductase | PF03358 | 1.20E−13 |
| 248 | 1892 | Adenylsucc_synt | 3, 422 | Adenylosuccinate synthetase | PF00709 | 2.90E−245 |
| 250 | 956 | PFK | 2, 277 | Phosphofructokinase | PF00365 | 1.70E−174 |
| 252 | 285 | RNA_pol_Rpb1_1 | 4, 331 | RNA polymerase Rpb1, domain 1 | PF04997 | 1.10E−150 |
| 252 | 285 | RNA_pol_Rpb1_2 | 333, 475 | RNA polymerase Rpb1, domain 2 | PF00623 | 3.00E−79 |
| 252 | 285 | RNA_pol_Rpb1_5 | 7, 731, 141 | RNA polymerase Rpb1, domain 5 | PF04998 | 4.70E−63 |
| 252 | 285 | RNA_pol_Rpb1_3 | 478, 666 | RNA polymerase Rpb1, domain 3 | PF04983 | 7.80E−44 |
| 252 | 285 | RNA_pol_Rpb1_4 | 691, 771 | RNA polymerase Rpb1, domain 4 | PF05000 | 4.70E−26 |
| 256 | 284 | RNA_pol_Rpb2_6 | 6, 791, 067 | RNA polymerase Rpb2, domain 6 | PF00562 | 1.50E−232 |
| 256 | 284 | RNA_pol_Rpb2_7 | 10, 691, 145 | RNA polymerase Rpb2, domain 7 | PF04560 | 3.40E−51 |
| 256 | 284 | RNA_pol_Rpb2_3 | 472, 544 | RNA polymerase Rpb2, domain 3 | PF04565 | 5.60E−41 |
| 256 | 284 | RNA_pol_Rpb2_1 | 29, 471 | RNA polymerase beta subunit | PF04563 | 5.10E−17 |
| 256 | 284 | RNA_pol_Rpb2_2 | 141, 329 | RNA polymerase Rpb2, domain 2 | PF04561 | 2.30E−07 |
| 258 | 1763 | Peptidase_M3 | 202, 584 | Peptidase family M3 | PF01432 | 6.20E−120 |
| 260 | 1198 | tRNA_synt_2f | 5, 559 | Glycyl-tRNA synthetase beta subunit | PF02092 | 9.10E−247 |
| 264 | 1202 | UPF0054 | 50, 157 | Uncharacterized protein family UPF0054 | PF02130 | 2.80E−34 |
| 266 | 267 | DEAD | 24, 192 | DEAD/DEAH box helicase | PF00270 | 4.00E−68 |
| 266 | 267 | Helicase_C | 259, 335 | Helicase conserved C-terminal domain | PF00271 | 2.70E−37 |
| 268 | 1599 | F_bP_aldolase | 4, 285 | Fructose-bisphosphate aldolase class-II | PF01116 | 7.40E−97 |
| 270 | 935 | HGTP_anticodon | 12, 111 | Anticodon binding domain | PF03129 | 5.70E−15 |
| 272 | 786 | Ribosomal_S4 | 33, 124 | Ribosomal protein S4/S9 N-terminal domain | PF00163 | 1.40E−28 |
| 272 | 786 | S4 | 125, 172 | S4 domain | PF01479 | 9.00E−23 |
| 274 | 716 | PGM_PMM_I | 2, 141 | Phosphoglucomutase/phosphomannomutase, alpha/beta/alpha domain I | PF02878 | 1.90E−55 |
| 274 | 716 | PGM_PMM_III | 260, 372 | Phosphoglucomutase/phosphomannomutase, alpha/beta/alpha domain III | PF02880 | 1.70E−26 |
| 274 | 716 | PGM_PMM_II | 160, 258 | Phosphoglucomutase/phosphomannomutase, alpha/beta/alpha domain II | PF02879 | 1.70E−24 |
| 276 | 1238 | PALP | 8, 297 | Pyridoxal-phosphate dependent enzyme | PF00291 | 4.70E−121 |
| 278 | 733 | DUF28 | 5, 239 | Domain of unknown function DUF28 | PF01709 | 1.70E−148 |
| 280 | 779 | ATP-synt_DE_N | 7, 92 | ATP synthase, Delta/Epsilon chain, beta-sandwich domain | PF02823 | 5.20E−19 |
| 280 | 779 | ATP-synt_DE | 94, 144 | ATP synthase, Delta/Epsilon chain, long alpha-helix domain | PF00401 | 1.40E−10 |
| 282 | 846 | Trigger_N | 1, 152 | Bacterial trigger factor protein (TF) | PF05697 | 1.40E−61 |
| 282 | 846 | Trigger_C | 240, 416 | Bacterial trigger factor protein (TF) C-terminus | PF05698 | 4.60E−59 |
| 282 | 846 | FKBP_C | 153, 239 | FKBP-type peptidyl-prolyl cis-trans isomerase | PF00254 | 3.50E−27 |
| 284 | 654 | E1-E2_ATPase | 88, 321 | E1-E2 ATPase | PF00122 | 5.90E−91 |

TABLE 6-continued

PFAM Results for Amino Acid Sequences

| SEQ ID NO: | ORF | Domain | Amino Acid Range, Start, Stop | Family | PFAM Accession No. | E-value |
|---|---|---|---|---|---|---|
| 284 | 654 | Cation_ATPase_C | 762, 914 | Cation transporting ATPase, C-terminus | PF00689 | 1.20E−30 |
| 284 | 654 | Hydrolase | 325, 664 | haloacid dehalogenase-like hydrolase | PF00702 | 4.00E−22 |
| 284 | 654 | Cation_ATPase_N | 12, 82 | Cation transporter/ATPase, N-terminus | PF00690 | 3.60E−15 |
| 286 | 422 | Thioredoxin | 1, 103 | Thioredoxin | PF00085 | 1.60E−32 |
| 288 | 1581 | Thioredoxin | 3, 106 | Thioredoxin | PF00085 | 8.60E−09 |
| 290 | 1418 | Oxidored_FMN | 2, 246 | NADH: flavin oxidoreductase/NADH oxidase family | PF00724 | 4.40E−11 |
| 294 | 887 | Nitroreductase | 6, 143 | Nitroreductase family | PF00881 | 3.70E−09 |
| 296 | 666 | RecA | 8, 329 | recA bacterial DNA recombination protein | PF00154 | 5.20E−226 |
| 298 | 1969 | cNMP_binding | 31, 124 | Cyclic nucleotide-binding domain | PF00027 | 6.40E−17 |
| 298 | 1969 | Crp | 174, 205 | Bacterial regulatory proteins, crp family | PF00325 | 5.30E−09 |
| 300 | 544 | cNMP_binding | 26, 118 | Cyclic nucleotide-binding domain | PF00027 | 2.00E−14 |
| 302 | 818 | CSD | 1, 67 | 'Cold-shock' DNA-binding domain | PF00313 | 3.90E−16 |
| 304 | 205 | HSP20 | 39, 141 | Hsp20/alpha crystallin family | PF00011 | 6.60E−25 |
| 306 | 278 | Peptidase_M41 | 421, 626 | Peptidase family M41 | PF01434 | 3.00E−97 |
| 306 | 278 | AAA | 228, 415 | ATPase family associated with various cellular activities (AAA) | PF00004 | 3.10E−97 |
| 306 | 278 | FtsH_ext | 40, 202 | FtsH Extracellular | PF06480 | 1.30E−32 |
| 308 | 679 | Pyr_redox | 6, 287 | Pyridine nucleotide-disulfide oxidoreductase | PF00070 | 2.20E−73 |
| 310 | 833 | FTSW_RODA_SPOVE | 9, 385 | Cell cycle protein | PF01098 | 1.10E−81 |
| 312 | 851 | Orn_Arg_deC_N | 38, 299 | Pyridoxal-dependent decarboxylase, pyridoxal binding domain | PF02784 | 4.90E−77 |
| 312 | 851 | Orn_DAP_Arg_deC | 302, 410 | Pyridoxal-dependent decarboxylase, C-terminal sheet domain | PF00278 | 6.40E−35 |
| 314 | 932 | RelA_SpoT | 240, 350 | Region found in RelA/SpoT proteins | PF04607 | 4.80E−53 |
| 314 | 932 | TGS | 391, 454 | TGS domain | PF02824 | 6.50E−31 |
| 314 | 932 | HD | 50, 149 | HD domain | PF01966 | 4.50E−12 |
| 318 | 1012 | PTS_EIIA_1 | 25, 129 | phosphoenolpyruvate-dependent sugar phosphotransferase system, EIIA 1 | PF00358 | 8.70E−45 |
| 318 | 1012 | PTS_EIIC | 278, 562 | Phosphotransferase system, EIIC | PF02378 | 5.10E−40 |
| 318 | 1012 | PTS_EIIB | 173, 207 | phosphotransferase system, EIIB | PF00367 | 5.40E−16 |
| 320 | 1014 | Alpha-amylase | 11, 413 | Alpha amylase, catalytic domain | PF00128 | 1.00E−112 |
| 322 | 1255 | GTP_EFTU | 378, 545 | Elongation factor Tu GTP binding domain | PF00009 | 1.70E−57 |
| 322 | 1255 | IF2_N | 1, 53; 296, 347 | Translation initiation factor IF-2, N-terminal region | PF04760 | 4.80E−34 |
| 322 | 1255 | GTP_EFTU_D2 | 568, 631 | Elongation factor Tu domain 2 | PF03144 | 2.20E−18 |
| 326 | 1260 | DUF150 | 11, 154 | Uncharacterized BCR, YhbC family COG0779 | PF02576 | 1.40E−47 |
| 328 | 1263 | Peptidase_M50 | 6, 411 | Peptidase family M50 | PF02163 | 2.80E−67 |
| 330 | 1286 | Ribosomal_L19 | 2, 114 | Ribosomal protein L19 | PF01245 | 4.00E−61 |
| 332 | 1288 | RimM | 5, 87 | RimM N-terminal domain | PF01782 | 2.40E−21 |
| 332 | 1288 | PRC | 93, 168 | PRC-barrel domain | PF05239 | 1.40E−14 |
| 334 | 1291 | UPF0122 | 4, 104 | Putative helix-turn-helix protein, YlxM/p13 like | PF04297 | 6.40E−24 |
| 336 | 1292 | AA_permease | 32, 475 | Amino acid permease | PF00324 | 2.20E−23 |
| 338 | 1294 | Peptidase_U34 | 6, 405 | Peptidase family U34 | PF03577 | 6.80E−213 |
| 342 | 1898 | Pyr_redox | 5, 288 | Pyridine nucleotide-disulfide oxidoreductase | PF00070 | 2.60E−72 |
| 344 | 889 | Enolase_C | 139, 427 | Enolase, C-terminal TIM barrel domain | PF00113 | 2.30E−126 |
| 344 | 889 | Enolase_N | 5, 135 | Enolase, N-terminal domain | PF03952 | 1.40E−58 |
| 346 | 845 | GTP_EFTU | 11, 205 | Elongation factor Tu GTP binding domain | PF00009 | 1.90E−98 |
| 346 | 845 | GTP_EFTU_D3 | 301, 395 | Elongation factor Tu C-terminal domain | PF03143 | 6.60E−57 |
| 346 | 845 | GTP_EFTU_D2 | 226, 296 | Elongation factor Tu domain 2 | PF03144 | 2.30E−22 |
| 348 | 600 | XFP | 5, 797 | D-xylulose 5-phosphate/D-fructose 6-phosphate phosphoketolase | PF03894 | 0 |
| 350 | 776 | ATP-synt_ab | 190, 370 | ATP synthase alpha/beta family, nucleotide-binding domain | PF00006 | 5.00E−103 |
| 350 | 776 | ATP-synt_ab_C | 376, 480 | ATP synthase alpha/beta chain, C terminal domain | PF00306 | 2.40E−37 |
| 350 | 776 | ATP-synt_ab_N | 24, 92 | ATP synthase alpha/beta family, beta-barrel domain | PF02874 | 9.90E−18 |
| 352 | 970 | Bac_DNA_binding | 2, 91 | Bacterial DNA-binding protein | PF00216 | 4.10E−51 |
| 354 | 699 | PGK | 1, 403 | Phosphoglycerate kinase | PF00162 | 1.20E−218 |
| 356 | 8 | SSB | 2, 104 | Single-strand binding protein family | PF00436 | 2.40E−35 |
| 358 | 1468 | Bgal_small_N | 4, 197 | Beta galactosidase small chain, N terminal domain | PF02929 | 3.30E−94 |
| 358 | 1468 | Bgal_small_C | 206, 315 | Beta galactosidase small chain, C terminal domain | PF02930 | 8.40E−61 |
| 362 | 1201 | KH_2 | 231, 295 | KH domain | PF07650 | 2.40E−28 |
| 364 | 935 | tRNA-synt_2b | 8, 160 | tRNA synthetase class II core domain (G, H, P, S and T) | PF00587 | 1.30E−37 |
| 364 | 935 | HGTP_anticodon | 333, 423 | Anticodon binding domain | PF03129 | 7.80E−16 |
| 366 | 786 | Ribosomal_S4 | 2, 92 | Ribosomal protein S4/S9 N-terminal domain | PF00163 | 3.20E−26 |
| 366 | 786 | S4 | 93, 140 | S4 domain | PF01479 | 2.10E−22 |
| 368 | 892 | CBAH | 2, 313 | Linear amide C-N hydrolases, choloylglycine hydrolase family | PF02275 | 3.9E−114 |

TABLE 6-continued

PFAM Results for Amino Acid Sequences

| SEQ ID NO: | ORF | Domain | Amino Acid Range, Start, Stop | Family | PFAM Accession No. | E-value |
|---|---|---|---|---|---|---|
| 370 | 1078 | CBAH | 2, 313 | Linear amide C-N hydrolases, choloylglycine hydrolase family | PF02275 | 1E−105 |

TABLE 7

Strains and plasmids used in this study

| Strain or plasmid | Characteristic(s) | Reference or source |
|---|---|---|
| Strain | | |
| *E. coli* EC1000 | RepA+ MC1000; Kmr; host for pOR128-based plasmids | Law et al. (1995) J. Bacteriol. 177: 7011-7018. |
| *L. acidophilus* NCFM | Human intestinal isolate | Barefoot and Klaenhammer (1983) Appl. Environ. Microbiol. 45: 1808-1815. |
| *L. acidophilus* NCK1398 | NCFM integrant IacL::pTRK685 | Russell and Klaenhammer (2001) Appl. Environ. Microbiol. 67: 4361-4364. |
| *L. acidophilus* NCK1392 | NCFM containing pTRK669 | |
| *L. acidophilus* NCK1678 | NCFM integrant ORF La57 (glutamate/GABA antiporter)::pTRK803 | This study |
| *L. acidophilus* NCK1680 | NCFM integrant ORF La867 (transcriptional regulator)::pTRK804 | This study |
| *L. acidophilus* NCK1682 | NCFM integrant ORF La995 (amino acid permease)::pTRK805 | This study |
| *L. acidophilus* NCK1684 | NCFM integrant ORF La996 (ornithine decarboxylase)::pTRK806 | This study |
| Plasmid | | |
| pTRK803 | 576-bp internal region of ORF La57 cloned into the BglII/XbaI sites of pOR128 | This study |
| pTRK804 | 593-bp internal region of ORF La867 cloned into the BglII/XbaI sites of pOR128 | This study |
| pTRK805 | 604-bp internal region of ORF La995 cloned into the BglII/XbaI sites of pOR128 | This study |
| pTRK806 | 624-bp internal region of ORF La996 cloned into the BglII/XbaI sites of pOR128 | This study |

TABLE 8

Primers used for PCR amplification

| SEQ ID NO: | Internal primers[a] | External primers[b] |
|---|---|---|
| 1 | Forward GATCTCTAGA-CCAGCAATCCAGTT (SEQ ID NO:369) | Forward GCATGCCAGCGATAAAGAAT (SEQ ID NO:370) |
| | Reverse GATCAGATCT-CTACACCGCTGATG (SEQ ID NO:371) | Reverse AAGGTGGTTCGCTCAGAAAT (SEQ ID NO:372) |
| 52 | Forward GATCTCTAGA-ATATTGCGGTTGG (SEQ ID NO:373) | Forward GCACCTCAACAAAGTGATCAG (SEQ ID NO:374) |
| | Reverse GATCAGATCT-AGTGGGAAACATCG (SEQ ID NO:375) | Reverse AAAGGCCCTTAGATGGAAC (SEQ ID NO:376) |
| 62 | Forward GATCTCTAGA-AGCCTGAGCCATAC (SEQ ID NO:377) | Forward ACAGTGTAGCCCTTGTAG (SEQ ID NO:378) |
| | Reverse GATCAGATCT-AGCGATACCGTTCC (SEQ ID NO:379) | Reverse CCATACTTGGAGGAGAAC (SEQ ID NO:380) |
| 60, 316 | Forward GATCTCTAGA-TGCTGCGCCTTACA (SEQ ID NO:381) | Forward AGTTGGCCAGTCATTGCT (SEQ ID NO:382) |
| | Reverse GATCAGATCT-TAGGGCACCCGTTC (SEQ ID NO:383) | Reverse TCGCCAAGATCACGAAGA (SEQ ID NO:384) |

[a]Primer sets used to amplify the internal region for gene inactivation.
[b]Primer sets used to amplify junction fragments.

TABLE 9

Analysis of *L. acidophilus* NCFM and bsh mutants on different bile salts.

| | NCFM | | ΔbshA | | ΔbshB | |
|---|---|---|---|---|---|---|
| | Growth | Precipitation | Growth | Precipitation | Growth | Precipitation |
| TDCA (0.2%) | +++ | +++ | +++ | +++ | +++ | − |
| TCA (0.2%) | +++ | ++ | +++ | ++ | +++ | − |
| TCDCA (0.05%) | +++ | +++ | +++ | +/− | +/− | − |
| GDCA (0.2%) | ++ | +++ | ++ | ++ | ++ | +++ |
| GCA (0.2%) | +++ | +++ | +++ | +++ | +++ | +++ |
| GCDCA (0.05%) | + | + | + | +/− | ++ | ++ |

TDCA, taurodeoxycholic acid;
TCA, taurocholic acid;
TCDCA, taurochenodeoxycholic acid;
GDCA, glycodeoxycholic acid;
GCA, glycocholic acid;
GCDCA, glycochenodeoxycholic acid.

SEQUENCE LISTING (381 sequences)

SEQ ID NO: 1 - DNA, 1440 bp, Lactobacillus acidophilus
  CDS (1)...(1440)
  misc_feature (0)...(0): ORF 57; GadC - Glutamate:gamma aminobutyrate antiporter
ttgaatgacgagaaaacagaagattgggctttagagcaagatcttaagtacaatcggttaacggcatttaagctgtttgcgatgactagttcaatggttatttccgttgatgaactagcaccgtttggcaagactggtgctactgcactattttatttgctaattgctggaattgcctggtttattcccatcactcaaatggctggtgaaatggcttcaattaacggttgggaaaaaggcggtatttttacttgggtaaaaggttcactgggcgataagactggatggactgctatgttttatcaatggatccatattacagttgggatggataccatgatgtatgtgattattggtgctctttcaatcacttttaatacgccttggtttaatactacaccgctgatgcgtttcattttgatgatgattattttatggggtgctacggcaattcagataattggtattaaaaagataggtagaatcgctgaatggctcttcattcttggaatttcgacacctgtaatccttttgattatttcgttttttgtttatgtgttacaagggcatcccttacatatgacaattaattggaatacggttatcccacatcaattaaatggcactacactagttgcatttgttcctttcatgttggctttttgtggtggtgaagcatctgctccacatgttaaaaatttggatcatcctaagtcatattcaaaagttatgcttgctttagcaattacagctatttgttttgatcttttaggtagtatggcaattggaatgacagttcctaaagatcaaattcaaaatagtactggttttgtttacacttatggtaagttacttacttcaattggattaccaggagatgttttacaaaaaattgttgggataatgctagcatgcggaattatcggtgaattgggtaactggattgctggtcctaaccaagggatgtatgaagctgctaaagatggttacatgcctaaattttttgccaaaactactaagcatggtgtaccaatcagaattatgattttacaatcaagtattgtaactatttctgcattattaattacctttactagtggtgctgatgccgattttgcatttaatgtatctttagctgccactacagcacagtatttaatggtttatatgataatgttgatttcttacattgttttgaagagaaaacatgaagattatcaccgtatgtattacatgaccaaaaatcccaatttaagtattgcaattgctgcagtagcactagttattactattgtggcattctttgtaacctttgttcctgcacaaggaaccccgatccggttacgtcatatttatatttggacattagttggtatgtgtgcaattgtttcagtattaccgttgattctttatcgctggcatgcaaaatggcaaaatcaa

SEQ ID NO: 2 - protein, 480 aa, Lactobacillus acidophilus
MNDEKTEDWALEQDLKYNRLTAFKLFAMTSSMVISVDELAPFGKTGATALFYLLIAGIAWFIPITQMAGEMASINGWEKGGIFTWVKGSLGDKTGWTAMFYQWIHITVGMDTMMYVIIGALSITFNTPWFNTTPLMRFILMMIILWGATAIQIIGIKKIGRIAEWLFILGISTPVILLIISFFVYVLQGHPLHMTINWNTVIPHQLNGTTLVAFVPFMLAFCGGEASAPHVKNLDHPKSYSKVMLALAITAICFDLLGSMAIGMTVPKDQIQNSTGFVYTYGKLLTSIGLPGDVLQKIVGIMLACGIIGELGNWIAGPNQGMYEAAKDGYMPKFFAKTTKHGVPIRIMILQSSIVTISALLITFTSGADADFAFNVSLAATTAQYLMVYMIMLISYIVLKRKHEDYHRMYYMTKNPNLSIAIAAVALVITIVAFFVTFVPAQGTPIRLRHIYIWTLVGMCAIVSVLPLILYRWHAKWQNQ

SEQ ID NO: 3 - DNA, 1269 bp, Lactobacillus acidophilus
  CDS (1)...(1269)
  misc_feature (0)...(0): ORF 83; Serine protease HtrA
atgatattaggtaatatgaggggagagttaagtatggtagaaaatcaaaataataatcaacgaccaagaaaaaatagtaatgcaaagatcatcactactgcagctattgtaggtgtagttggtggtctgatcggcggtggcgtttcatattatgcagctgatcaaatgaataacgctactgatactactacggcacaaactagtgtatcttcaaatagtagtaaggtatccgaaaaaagtgctaaaaccagtggtacgatgactactgcttataatgatgtaaaaggggctgtagtgtccgttattaacttaaagagacaatcatcctcaagtagcgctaactctctttacagcagcttatttggggatgatagcgatagttcttcaggtaagagcggcaagcttgagacttacagtgaaggttccagtgtagtttatatgaagtcaaatggtaaaggctatattgtaactaataatcacgttatttcaggcagtgatgcagttcaagtgcaacttgctaatggcaagactgttagtgcaaaggttgttgggaaagatagtactactgacttagctgttttatcaattgacgctaagtacgtaacacaaacagccgaatttggcgattctaagagtcttcaagctggtcaaactgtaattgctgtaggttcaccacttggtagtgaatatgcttctacggtaacgcaaggtattatatcagcaccggctagaactatctcaacttcatctggtaatcagcaaacagttattcaaacagatgcagccattaacccaggtaactcaggtggtgcattggttaactcagctggtcaagttatcggtattaattctatgaagcttgctcaatcaagtgatggtacttctgtagaaggtatgggatttgctattccttcgaatgaagttgtaactatcgtaaatgaattggttaagaagggtaagattactcgtccacaacttggtgtaagagtagttgctcttgaaggtattcctgaagcatacagaagtcgcttaaagattaagtcaaaccttaagagtggtatctatgttgcttcaattaataagaatagttcagctgcaaatgcaggcatgaagagcggtgatgtcattactaaggtagatggcaagaaggttgatgatgtagcatcattacacagtatcctttacagtcacaaggttggtgacactgtgaacataactattaatagaaatggtagagatgtcaacttaaaggtaaaacttgaaggtaat

SEQ ID NO: 4 - protein, 423 aa, Lactobacillus acidophilus
MILGNMRGELSMVENQNNNQRPRKNSNAKIITTAAIVGVVGGLIGGGVSYYAADQMNNATDTTTAQTSVSSNSSKVSEKSAKTSGTMTTAYNDVKGAVVSVINLKRQSSSSSANSLYSSLFGDDSDSSSGKSGKLETYSEGSSVVYMKSNGKGYIVTNNHVISGSDAVQVQLANGKTVSAKVVGKDSTTDLAVLSIDAKYVTQTAEFGDSKSLQAGQTVIAVGSPLGSEYASTVTQGIISAPARTISTSSGNQQTVIQTDAAINPGNSGGALVNSAGQVIGINSMKLAQSSDGTSVEGMGFAIPSNEVVTIVNELVKKGKITRPQLGVRVVALEGIPEAYRSRLKIKSNLKSGIYVASINKNSSAANAGMKSGDVITKVDGKKVDDVASLHSILYSHKVGDTVNITINRNGRDVNLKVKLEGN

SEQ ID NO: 5 - DNA, 894 bp, Lactobacillus acidophilus
  CDS (1)...(894)
  misc_feature (0)...(0): ORF 96; HtpX - probable protease homolog
atgttgtaccaacaaattgcccgtaacaagcgtaaaactgcgctaattatggttctttttgtggtaatcttgaccttagttggtgctggactgggctatctttttagcaatagtccatggacgggaataatcattgcattagctggtagcttaatctatctattaattatgtggcaaaacccagctaacatgattatgagtctcaatcatgctcaggaaattcaagaagctgataaccctgagttgtggcatattgtagaagatatggcaatggtagctcgtgtaccaatgccacgcgtttttattattcctgatcctagcccgaatgcttttgcaacggggcgtgatcctgaacacagcgctgttgccgtaacgcaaggaattcttgaattaatgaatcgagaagagcttgaaggcgttctgggtcatgaattatcacacgtacgtaattacgatattttattatcaacaatcggtgtagttttggtgggtgttatttcctttatttctggaatagcttctcgctatatttggtttttcggtggtaatcgtcgagacgatgaagatcgagacaccaatgcatttgaaataatttttaaagtcatcgctattgtctttgtattaattttaggtcctatttctgcatccctcgcacaaatggccctatcacgtaatcgagaatatttagctgatgcttcttctgttgaattaacccgtaatccacaaggcttaatctccgcattaagaaagattgaaggcagtcagcctatgcgtcaagcagatcgtagtagtgccgggttatatattgagaacccatttcacaatcacggtctatctcacttatttgacacacatccaccgacagaagatagaatcaaacgattagaacacatg

SEQ ID NO: 6 - protein, 298 aa, Lactobacillus acidophilus
MLYQQIARNKRKTALIMVLFVVILTLVGAGLGYLFSNSPWTGIIIALAGSLIYLLIMWQNPANMIMSLNHAQEIQEADNPELWHIVEDMAMVARVPMPRVFIIPDPSPNAFATGRDPEHSAVAVTQGILELMNREELEGVLGHELSHVRNYDILLSTIGVVLVGVISFISGIASRYIWFFGGNRRDDEDRDTNAFEIIFKVIAIVFVLILGPISASLAQMALSRNREYLADASSVELTRNPQGLISALRKIEGSQPMRQADRSSAGLYIENPFHNHGLSHLFDTHPPTEDRIKRLEHM

SEQ ID NO: 7 - DNA, 786 bp, Lactobacillus acidophilus
  CDS (1)...(786)
  misc_feature (0)...(0): ORF 115; TerC family protein - ortholog of stress response protein DNA sequen
atggcaattcttaaaatgtatgctccattttttgatggtaacaattggttgcatgttttaacaagcggcaaggactggatgatcattctgactttaattattatggaatgtcttctttcagttgataatgctgtagttttagcagctcaaacacaggtactacccacaaaaagtgagaaagaaaaatccttattatacggactttggggagcatatctttttagattcattgtaattggaataggtacttatttaattaacttctgggaaatcaaattagccggtagtatatatctattctatttatcaattaaattcttctatgatcaacgccaccctaaagaagttgttgaacacgaaaaagaaaaagaagcccgtgaaaaagcacactataaaaataaaaagaagaaaaaacacgttctttcacttttttggcgaacggttatttcgattgaatcaatggatattgttttctcaattgactctgttcttgcagcattagctatttcggataatcccgtagttgttttgattggtggaatgatcggtatcctctgcatgagaggtgtagccgaaattataattaaattaatggatataattccagaattagaacctatggcttacgttttaattggaattattgcattaaaattattattagctctgccaccacttaaatgggaaatgccaaatacggcatttgcaattatcgtatttgcaatattgggtttaactattattttccacttctggcgtgttaaaaaacatggacataaacattta

SEQ ID NO: 8 - protein, 262 aa, Lactobacillus acidophilus
MAILKMYAPFFDGNNWLHVLTSGKDWMIILTLIIMECLLSVDNAVVLAAQTQVLPTKSEKEKSLLYGLWGAYLFRFIVIGIGTYLINFWEIKLAGSIYLFYLSIKFFYDQRHPKEVVEHEKEKEAREKAHYKNKKKKKHVLSLFWRTVISIESMDIVFSIDSVLAALAISDNPVVVLIGGMIGILCMRGVAEIIIKLMDIIPELEPMAYVLIGIIALKLLLALPPLKWEMPNTAFAIIVFAILGLTIIFHFWRVKKHGHKHL

SEQ ID NO: 9 - DNA, 1455 bp, Lactobacillus acidophilus
  CDS (1)...(1455)
  misc_recomb (0)...(0): ORF 119; Cardiolipin synthase
atggtctggtggcacgactttatcagaattatctttattactaacacgatcttagctttttacattgttttccatcgtagacgttcagtatcaacaacctgggcttggttaattattttgctcattttccctatcgttggaattacactttacgcattttttggtcgtggtatttcccaggaaaacatttttgcaattaacaaacagcaccacattggcttacgtaatgtacaaaaatccattgcaaaagctcctaaaaaaacaagtccttcagatacatcaaatataggacaaattgccatcaacttttttaatcaagatgatgaagctcctgtaaccaaaaataataatgtaaaactatatacagaaggcaatactttttttcatgatatgttaaaagatattgttagggcaaaagaaactatcaatattgaattttatactttttataatgatgacatcggtaatcgtgtcctgcagctattgataaaaaaagcacaacaaggtgttaaagttcgcgttgtctatgatgcatggggatcaatgggagctactaaagcttggtttgaccaattacgcaaagccggtggtaaagttctcccctttatcacatcaagaaatatgattacgagatatcggatcaattaccacctacaccgaaaaattgttgttatcgatggtaagatttcttggactggtggtttcaacatcggggatcaatacttaggaagaaaaaagaaatttggtcattggcgtgatagtcaggtacgtattgttggttccgcctcacttttattacaagaacgatttgtcatggattggaacgcttctataaataatgatgatgagattattcgctttaattccactttatttcctgatcttgacgaaaagaatattcatcaagatgacgttgccacacagattatttcagatggaccggatcgttatacatcttatatgcgtaacggcatgatgcgtctaatgctacttgctaggaaccgcttgtgggtacaaacgccttacttaattcctgatgatgcagtttttgcaacttggcaaactatcgccatgtctggagttgacgtcagaattatgattccatgcaagccagaccatccattcatctatcgtgcaactcaatggtatgccaatgaattaacacgtttcggcgtaaaaatttatatttatgaagatggatttttacacgctaaaactactattattgatgataacttctcctcagtgggttcaatgaaccaggactatcgatcatacagtcttaattttgaggataatgctattttttatgataaaaatttcaataaaaaaatggctgaggcttttgaagaagacatgaaaaaaagtcacctgcttactcctgaagaaataaaaaagcaaggtcgctggctgcgaaccttacaaagtttctctcgtatgctttcaccaattctg

SEQ ID NO: 10 - protein, 485 aa, Lactobacillus acidophilus
MVWWHDFIRIIFITNTILAFYIVFHRRRSVSTTWAWLIILLIFPIVGITLYAFFGRGISQENIFAINKQHHIGLRNVQKSIAKAPKKTSPSDTSNIGQIAINFFNQDDEAPVTKNNNVKLYTEGNTFFHDMLKDIVRAKETINIEFYTFYNDDIGNRVLQLLIKKAQQGVKVRVVYDAWGSMGATKAWFDQLRKAGGKVLPFITSRNMITRYRINYHLHRKIVVIDGKISWTGGFNIGDQYLGRKKKFGHWRDSQVRIVGSASLLLQERFVMDWNASINNDDEIIRFNSTLFPDLDEKNIHQDDVATQIISDGPDRYTSYMRNGMMRLMLLARNRLWVQTPYLIPDDAVFATWQTIAMSGVDVRIMIPCKPDHPFIYRATQWYANELTRFGVKIYIYEDGFLHAKTTIIDDNFSSVGSMNQDYRSYSLNFEDNAIFYDKNFNKKMAEAFEEDMKKSHLLTPEEIKKQGRWLRTLQSFSRMLSPIL

SEQ ID NO: 11 - DNA, 1371 bp, Lactobacillus acidophilus
  CDS (1)...(1371)
  misc_feature (0)...(0): ORF 175; S-layer protein
atgaagaaaaatttaagaatcgttagcgctgctgctgctgctttacttgctgttgctccagttgctgcttctgctgtatctactgttaacgctgccgctgttaatgctattgctgttggcggttcagctaccccattaccaaacaactcagatgtacaaattagttcatcagttgctggtgtaactactaagaatggctcaagctacactaacggtagaatttctggttctatcaacgcttcttacaacggtacaagctattcagcaaactttagttcatcaaatgcaggtgttgttgtttcaactccaggccatactgaacttagtggtgaacaaattaacggtcttgaaccaggtagtgctgtaactgttactttaagagatggtgtttcatttaactttggttcaactaatgctaacaagactattactttagcatttccaaagaacgtatcagctgctggtttagctgatgctaacaaggtttcagctacttcagaaacttcagttgatgcaggcaagactatccaagttaagactgacaagaacggtgttgtaagcttcggttcagcacaagttcttaacgttaaggttgttgaaactagcgacgttagagctgtttcattctacgacatccaaactggtaagactgtagaaaacggtactctttcaatcgttgctggttctaacgcacgtgctaacgtacaagaaatcgttaacgcatttaacgctaagtaccaagcttctcaattgaacaacgctaacagcaatgctaacgttcgtttgactgacaacaacgctcaagctgttgctactatgttaagagctcaaaacattgatgttgatgcacaaggttacttcactgcaccagcttcattgagcttaactttccacgcagaatcaactcaaaacaatgaaactgcacaattaccagtaactgtttcagtaactaacggtaaggaagttactccttcaactgtagacagcgtaagcaagagaattatgcacaatgcatactactacgacaaggacgctaagcgtgttggtactgacagcgttaagcgttacaactcagtaagcgtattgccaaacactactactatcaacggtaaggcttactaccaagtagttgaaaacggcaaggcagttgacaagtacatcaacgctgcaaacatcgatggtactaagcgtactttgaagcacaacgcttacgtttacgcatcatcaaagaaacgtgctaacaaggttgtattgaagaagggtgaagttgtaactacttacggtgcttcatacacattcaagaacggccaaaagtactacaagatcggtgacaacactgacaagacttacgttaaggttgcaaactttaga

SEQ ID NO: 12 - protein, 457 aa, Lactobacillus acidophilus
MKKNLRIVSAAAAALLAVAPVAASAVSTVNAAAVNAIAVGGSATPLPNNSDVQISSSVAGVTTKNGSSYTNGRISGSINASYNGTSYSANFSSSNAGVVVSTPGHTELSGEQINGLEPGSAVTVTLRDGVSFNFGSTNANKTITLAFPKNVSAAGLADANKVSATSETSVDAGKTIQVKTDKNGVVSFGSAQVLNVKVVETSDVRAVSFYDIQTGKTVENGTLSIVAGSNARANVQEIVNAFNAKYQASQLNNANSNANVRLTDNNAQAVATMLRAQNIDVDAQGYFTAPASLSLTFHAESTQNNETAQLPVTVSVTNGKEVTPSTVDSVSKRIMHNAYYYDKDAKRVGTDSVKRYNSVSVLPNTTTINGKAYYQVVENGKAVDKYINAANIDGTKRTLKHNAYVYASSKKRANKVVLKKGEVVTTYGASYTFKNGQKYYKIGDNTDKTYVKVANFR

SEQ ID NO: 13 - DNA, 441 bp, Lactobacillus acidophilus
  CDS (1)...(441)
  misc_feature (0)...(0): ORF 205; Putative heat shock protein
atgaaaggaagttttattatggcaaacgatatgatgaatcgtcgcaatgatatgatggatgcaatgaacgattggtttggttttccaagaaacttctttgatgacagcgaaattgaaaatatcatgcaatcagatgttgcagaaactgataaggactatgtagttaagattgatatgcccggcatgaataaagacgacatcaaacttaattacaaagatggcgttttaagcgtggccggtactagaaaagcctttaaagatactaacgataaggaaagaaatatcatccacaaagaaagaagcgaaggtagtatctcaagaagctatagattgccaaatgtagttgcaaatgagattcatgcaaagtatgataatggtgtattaaccatcaccctaccaaagcaaactgctggggatgatgataattctatccagattgat

SEQ ID NO: 14 - protein, 147 aa, Lactobacillus acidophilus
MKGSFIMANDMMNRRNDMMDAMNDWFGFPRNFFDDSEIENIMQSDVAETDKDYVVKIDMPGMNKDDIKLNYKDGVLSVAGTRKAFKDTNDKERNIIHKERSEGSISRSYRLPNVVANEIHAKYDNGVLTITLPKQTAGDDDNSIQID

SEQ ID NO: 15 - DNA, 552 bp, Lactobacillus acidophilus
  CDS (1)...(552)
  misc_feature (0)...(0): ORF 232; RNA polymerase
gtgggattagacaaatttaaagacaaaaaccgcgatgaattgtcaatgatcgaagttgctcgcgcaattttggaagacaatggcaagagaatggcatttgctgacattgttaatgccgtacaaaaatacttaaataagagtgacgaagaaattcgtgaacgtttgccacaattctatactgatatgaacactgatggtgaatttatttctatgggtgaaaatgtttgggctcttcgctcatggttcccatatgaatcagttgatgaagaagttaaccacccagaagatgaagaagaagacgattcacgtaagcaccacaagaaggttaatgccttcttggcaagtgctaccggtgacgatgatatcatcgactacgacaatgatgatccagaagacgatgacttagacgcagccactgatgatagtgatgatgactacagtgatgacgattctgattatgatgaagataatgatgatgctgatgacgtattgccagacggtatcgaaggtcaattgtcacaattaaacgatgaagatgacgacgaagatgat

SEQ ID NO: 16 - protein, 184 aa, Lactobacillus acidophilus
MGLDKFKDKNRDELSMIEVARAILEDNGKRMAFADIVNAVQKYLNKSDEEIRERLPQFYTDMNTDGEFISMGENVWALRSWFPYESVDEEVNHPEDEEEDDSRKHHKKVNAFLASATGDDDIIDYDNDDPEDDDLDAATDDSDDDYSDDDSDYDEDNDDADDVLPDGIEGQLSQLNDEDDDEDD

SEQ ID NO: 17 - DNA, 2169 bp, Lactobacillus acidophilus
  CDS (1)...(2169)
  misc_feature (0)...(0): ORF 278; FtsH - Cell division protein
ttgcggaggttttttatgaagaataaccggaatcggctgctttcaaacggccttttctatatagttgtgttccttctgctcctatggggaatcaactgggcactaggcggctctaacaatagcggtagttcagaaaatattagctactcacaatttgttaaagatttgcgtcaaggcaaagttaaaaactttagtgttcaacctgctaatggtgtttacactgtttcaggtagttacaagactgcacaaacagcaaagaatcaatcaaatagtagttttgatttctttagtaataattcaagtagaaaagtatccagcttctctacaaccatgttacaaaatgattctaccgtttcgaatgtgcaaaacttggcacaaaagagtaacgctcggatgacaactcaaggagaatcacaatctggcaattggatttcaactattgtcatgcttgtaccaactgttttgtttattgtcatgctttggatgatgatgaatcaaagcggtgctggacgtggtggtagcggcggaataatgaattttggtcgttcacatgtcaaaccagaagatccttctaaaaataaggttcgtttctctgacgtagccggtgaagaagaagaaaagcaagaattagtcgaagttgttgaatttttgaaagatccatcaaaatacactaagttgggtgcgagaatcccatctggtgttttacttgagggccctcctggtactggtaagaccttacttgctcgtgctgtagcgggtgaagccaacgtaccattttactcaatttcaggttcagacttcgttgaaatgtttgtcggtgttggtgcaagtcgtgtacgtgatttatttagcaatgctaagaagaatgcaccaagtatcatctttatcgatgaaattgatgctattggtcgtcgtcgtggaaatggtaccggtggtggaaacgatgaacgtgaacaaacgttaaatcaattattggttgaaatggatggttttgaaggcgatgaaggtgtaatcgttattgccgcaactaatcgttcagatgtcttggatccagctttacttcgtccaggtcgttttgaccgtaaggtattagttggtcgtcctgatgttcgcggtcgtgaagctatcttaaaagttcatgctaagaataagccacttgctcctgatgttgacttaaaagaagtagctcgtcaaactccaggttttgtaggtgcggatttagctaatgttttaaatgaagctgcattggtagctgctcgtagaaacggtactgaaattaccgcgtcagatattgatgaagctgaggatcgtgtaattgctgggccagctaagaaggatcgtctaattgcagaaccagaaagacgtcgagttgcttttcacgaagcaggtcactcaatctgtggtttggtattgagcgattcaagaactgtacgtaaggtaactattgtgcctcgtggtcgtgctggtggatataacatcatgcttccaaaggatgatcaattcatcttaactaagaatcaattatttgaacaaattgttggtttaatgggtggtcgtgctggtgaagaagcaactattggtgataaatcaactggtgcttcaaacgactttgaacaagctacacaaattgctcatagtatggttgttaactatggtatgactgaatctctgggtatggttgagcttgaaaaagaaggcgaaagtaatccttatggattcaaaccttacagtgaggcaactgctgctaagattgatgaagcggttaagaaaatcttggatgaagctcatgctaaagcccttgaaatcgtaaaagaaaacaaggaaaagcacagaattattgctgaagctttacttaaatatgaaactttagatgaaaagcaaatcatgtccttatataagactggtaagatgcctgaaaaggatgaaactgaatatccaagtgaatcaaaagcttcaacttacgaagaagctaaggctgctgcagaaaaacgtgaagttgaaaaagcagaaaagaaagactcagatcaagctttagctgatcaagaaaaagatgctttggaaactccattagaaaagaatcatgaagtcgaagaacataatcccgaaaatcctgaaaaggacgaaaagactaattcaaataatgattcatctgcagacgatgagcaaaga

SEQ ID NO: 18 - protein, 723 aa, Lactobacillus acidophilus
MRRFFMKNNRNRLLSNGLFYIVVFLLLLWGINWALGGSNNSGSSENISYSQFVKDLRQGKVKNFSVQPANGVYTVSGSYKTAQTAKNQSNSSFDFFSNNSSRKVSSFSTTMLQNDSTVSNVQNLAQKSNARMTTQGESQSGNWISTIVMLVPTVLFIVMLWMMMNQSGAGRGGSGGIMNFGRSHVKPEDPSKNKVRFSDVAGEEEEKQELVEVVEFLKDPSKYTKLGARIPSGVLLEGPPGTGKTLLARAVAGEANVPFYSISGSDFVEMFVGVGASRVRDLFSNAKKNAPSIIFIDEIDAIGRRRGNGTGGGNDEREQTLNQLLVEMDGFEGDEGVIVIAATNRSDVLDPALLRPGRFDRKVLVGRPDVRGREAILKVHAKNKPLAPDVDLKEVARQTPGFVGADLANVLNEAALVAARRNGTEITASDIDEAEDRVIAGPAKKDRLIAEPERRRVAFHEAGHSICGLVLSDSRTVRKVTIVPRGRAGGYNIMLPKDDQFILTKNQLFEQIVGLMGGRAGEEATIGDKSTGASNDFEQATQIAHSMVVNYGMTESLGMVELEKEGESNPYGFKPYSEATAAKIDEAVKKILDEAHAKALEIVKENKEKHRIIAEALLKYETLDEKQIMSLYKTGKMPEKDETEYPSESKASTYEEAKAAAEKREVEKAEKKDSDQALADQEKDALETPLEKNHEVEEHNPENPEKDEKTNSNNDSSADDEQR

SEQ ID NO: 19 - DNA, 2475 bp, Lactobacillus acidophilus
  CDS (1)...(2475)
  misc_feature (0)...(0): ORF 283; ClpC - class III stress response related ATPase
atggaaaactcatacagtaaaagtgtaaatcaagtgttggaaattgcgcgtgaacaagcacagaatttccatcatcgtttaatcggaacagaacatattttattagccttagtaattgaaactgatggcgaagctggaaaaattttacgttcatgggggctgacgcctaccgctatacgtgaagaaattgaaagatatacaggatatggctcagctcccaaggctagctatatggaaatgtcacctcgattgagcttggctttagattatgctaaaagacaagcagaacaaggtggatataaagaaattaaaaccaatcatgtgttattaggtataactgctagtgagcaagttttatctgcaatgattttgaaaaacttaagcgtagatatcagtcgattacgtcaagatgctatcgacagcttggaacaggatcaagattttaatgattctgctaattggttaggtaatagtgattctaaccaaaagaaacgtaagaatagcactacgccaaccttggataaagtagcaattaacttgaatcaacgtacacgtgaaggaaatattgatcctgttattggacgtgataaggaaattgaacgtgtaattcaaattttgtcacgtagaactaagaataatccggttttagtaggtgagccaggtgtaggtaagacggctgttgctgaagcaattgctactgaaattgttaaaaagagagtgccagaagatctgttagataagcgagttatggcattaaatatgggtaacttggttgctggtactaaatatcgtggtgaattcgaagatcgaatgaagaagatcttggatgaaattgctaaagatggcaaagttatcttatttgttgatgaaatgcatactttaattggtgccggtggtgctgaaggcgcaattgatgcttctaatattttaaagccatcacttgctcgtggtgatgttcaaatgattggtgctactacatttgatgaataccaaaaatacattgaaaaagatcaagctttggcaagacgtttccaacaagtgcgcttaaatgaaccttcaaagaaagatacattagcaattttggaaggtttaaaacccaagtatgaaaaattccatcatgttactattactgaagaaagtctagaagacgcagttgatttatctagtcgatatatttctgatcgctttttaccagataaagccattgacttggtagacgaagctagtgctgctgtaaaaatcaaaaataatgttaattctgatgacgaattagtacagattaataacaagattaaaaatttaattgatcaaaaaaatgaagcagcagcaagtcaaaacttcgtaaaagctgctcaattacaagatgagcaaaataatttgcaagctcgtcgtgaaaaattagtaaatactttacatgaaaaaattagtgctaatgcgactgttgagcccgaagatattgccaaagtagtatctgattggactggcgttcctgttacccaaatgaaacgtaatgaaactcgtcaattagctaatttagaaggtattttacataagcgagttattggtcaagataaggctgtttctgcagttgctcgtgcaatccgtagaagtagaagcggaattaaggatgaacgtcgtccaattggctcattcttgttcttaggcccaactggtgtgggtaaaacagaattggctaaatctgttgctgcagcaatgtttggctcagaggataacctgatacggcttgatatgtctgaatacatggatcaaatcgcttcaagtaaattgatcggttcagcaccaggctatgtaggttatgaagaaggcggtcaactttcagaacaagttcgtcgccatccatattcagttgtgttgctcgatgaagtagaaaaagctcatcctgatgtatttaatctcttacttcaggtcttggatgaaggatttatgactgattctaagggaaggaaagttgattttagaaatacaatcattattatgacttctaaccttggttcacgttcattatttgatggcaatgcggttggattcaatgcggataaaattgatcaagcaaaagtaagacaagcgaaagttcaacaagctattaaacagttcttccgccctgaatttttaaacagaattgatgaaactattgtctttgatgaattaactaagaaacaacttcgtaacattgtaagtttacttactaataaattggtagttcgtttacaaagaaaaggtattactttgaaactttcacgtgctgctttagataagatcgtacaagatggttatgatccagaaaatggtgctcgtccacttaagagagctattcaaaatgatgtggaagataaagttgccgaaatgttaattaatggggaagttaagagtggtgatactcttaaaattggtagtcaacatggtaatttgaaattcgaagttgttgcacctaaaaaagaagtagaaaaagtcaag

SEQ ID NO: 20 - protein, 825 aa, Lactobacillus acidophilus
MENSYSKSVNQVLEIAREQAQNFHHRLIGTEHILLALVIETDGEAGKILRSWGLTPTAIREEIERYTGYGSAPKASYMEMSPRLSLALDYAKRQAEQGGYKEIKTNHVLLGITASEQVLSAMILKNLSVDISRLRQDAIDSLEQDQDFNDSANWLGNSDSNQKKRKNSTTPTLDKVAINLNQRTREGNIDPVIGRDKEIERVIQILSRRTKNNPVLVGEPGVGKTAVAEAIATEIVKKRVPEDLLDKRVMALNMGNLVAGTKYRGEFEDRMKKILDEIAKDGKVILFVDEMHTLIGAGGAEGAIDASNILKPSLARGDVQMIGATTFDEYQKYIEKDQALARRFQQVRLNEPSKKDTLAILEGLKPKYEKFHHVTITEESLEDAVDLSSRYISDRFLPDKAIDLVDEASAAVKIKNNVNSDDELVQINNKIKNLIDQKNEAAASQNFVKAAQLQDEQNNLQARREKLVNTLHEKISANATVEPEDIAKVVSDWTGVPVTQMKRNETRQLANLEGILHKRVIGQDKAVSAVARAIRRSRSGIKDERRPIGSFLFLGPTGVGKTELAKSVAAAMFGSEDNLIRLDMSEYMDQIASSKLIGSAPGYVGYEEGGQLSEQVRRHPYSVVLLDEVEKAHPDVFNLLLQVLDEGFMTDSKGRKVDFRNTIIIMTSNLGSRSLFDGNAVGFNADKIDQAKVRQAKVQQAIKQFFRPEFLNRIDETIVFDELTKKQLRNIVSLLTNKLVVRLQRKGITLKLSRAALDKIVQDGYDPENGARPLKRAIQNDVEDKVAEMLINGEVKSGDTLKIGSQHGNLKFEVVAPKKEVEKVK

SEQ ID NO: 21 - DNA, 888 bp, Lactobacillus acidophilus
  misc_feature (0)...(0): ORF 279; HSP 33 homologue - 33 kDa chaperonin
  CDS (1)...(888)
atgaatgattatttagtaaaatcaatcgataagactaagaatttacgcttgctaactataactgctaagggagtagttagtgaagcacaaaagcgtcatgatttatggtcagcttcttcagctgtactcggtcgtacattagtgggttcgcttttacttgctggggcagagcttactgataaagaagaattgactgttagattgttaggtaatggtccagtaggtccagctattgtaactgcaacagcagatttgaaagtcaaaggctatgttaagaaccctcatattgcattaccacctaaagaaaatggtcatattgatgtaaaaaaagctgttggtcaaggatggtttgaagtgactaaagatttgggtctgaaagaaccctatactggccaagttccaattgtttctggtgaaattgcagaagactttgcgtattacttaactaagtctgaacaaattccatcagctgtaggtttatcagttttcgtaaatccaaataattcaattggtgaagctggcggatttatgcttcaagcattacctggtgccagtgatgctttaattgataagacaattaaacgaattaatgaattgcctgctctttctacttcatttttagatggtatgacaccggaagatttggcacgtaaaattttaggtactgattgtaagattctggaaaaagatgatgttgcattcagctgtgattgttctaaagaaaaatatgcgggaattcttgaaactttaaagtcttcccaattaaaagatatgatcaatgaagatcatggagcagaacttatttgcaacttctgtggtaacaaataccattacactgaagatgaattgaaagagattttagctaagaaaaaagacgataaagattat

SEQ ID NO: 22 - protein, 296 aa, Lactobacillus acidophilus
MNDYLVKSIDKTKNLRLLTITAKGVVSEAQKRHDLWSASSAVLGRTLVGSLLLAGAELTDKEELTVRLLGNGPVGPAIVTATADLKVKGYVKNPHIALPPKENGHIDVKKAVGQGWFEVTKDLGLKEPYTGQVPIVSGEIAEDFAYYLTKSEQIPSAVGLSVFVNPNNSIGEAGGFMLQALPGASDALIDKTIKRINELPALSTSFLDGMTPEDLARKILGTDCKILEKDDVAFSCDCSKEKYAGILETLKSSQLKDMINEDHGAELICNFCGNKYHYTEDELKEILAKKKDDKDY

SEQ ID NO: 23 - DNA, 1236 bp, Lactobacillus acidophilus
  CDS (1)...(1236)
  misc_feature (0)...(0): ORF 414; DNA-damage inducible protein P
atgcatggcaaaaagaaaatgaaaaaggcaatccaaagattagtcaatacttgccatacagaatgggacccaaagaagctagtgacatttttgaatctccaactgaacattggatttatgaataacgaaaatttattgccgcaaaatgacatccatcgccggataattcatctggacatggatgctttttacgcttcggtagaaataaatcgacatccggaatataaagataaagcgttagttgtaggacaagatccaagagacaataacgggcatggtgttgttgcaacatgtaattatgttgctcgcaaatatggcgttcattcggctatggcaagtattcaagccttacgattagtaccaaaagataagatagtatttgtaccacctgattttgaaacatatcgtagtgtttctgcacaaattcattcttttatgcatgaaatcactgatcaggtagagtcgatagctctagatgaggcttatcttgatgtaactaagaataaaattggagaatattcagccgtacagatagcattaaatttacaaaaacgaattcgagcggaactgaatttaaattcttcttttggcgtttcttataataaatttttagctaaaatgggttcagagtacgctaagccatttggtagggtagtaattttgccggatgaagccaaaagatttttgggaatgcaaagaattgaaaaattcccaggtattggtccaaaaacgcaggaagaattacatagtatgaatgtgcatactggagcagatctgcaaaagattgatccatggattttacttaaaaaatttaaaaagatgggctatattttagctcagcatgctcatgggattgatttaagaccgattgtggcagattcagaaataaatcgcaaatctatcggtatagaacggacatatgaaccagctatttatagtcgagatgaagctttaaccaagatgcgtcgttattgtaagcatttagaaggggaacttaaaaagcgtgattttagagcaaatgtagttgtactgaaattgcgggataataattttaatacgattactaaacgtaaaaagttacctagttcttcagatagttatttagagttttatgatatagttcagggactttttgatagtactagtggctttttagaagaaggtattcgccttttaggcgtaaccgttacagattttaaaaaagaaaattatcaatcaattaatttgttcgatttt

SEQ ID NO: 24 - protein, 412 aa, Lactobacillus acidophilus
MHGKKKMKKAIQRLVNTCHTEWDPKKLVTFLNLQLNIGFMNNENLLPQNDIHRRIIHLDMDAFYASVEINRHPEYKDKALVVGQDPRDNNGHGVVATCNYVARKYGVHSAMASIQALRLVPKDKIVFVPPDFETYRSVSAQIHSFMHEITDQVESIALDEAYLDVTKNKIGEYSAVQIALNLQKRIRAELNLNSSFGVSYNKFLAKMGSEYAKPFGRVVILPDEAKRFLGMQRIEKFPGIGPKTQEELHSMNVHTGADLQKIDPWILLKKFKKMGYILAQHAHGIDLRPIVADSEINRKSIGIERTYEPAIYSRDEALTKMRRYCKHLEGELKKRDFRANVVVLKLRDNNFNTITKRKKLPSSSDSYLEFYDIVQGLFDSTSGFLEEGIRLLGVTVTDFKKENYQSINLFDF

SEQ ID NO: 25 - DNA, 534 bp, Lactobacillus acidophilus
  CDS (1)...(534)
  misc_feature (0)...(0): ORF 351; Possible sigma factor
atgtgtactgaagagaagttaattaataaagcaaaaatgggtgatgatcaggcattaaaagaattgtttttcttgtataaaccattagttaattcaattctaaagaaatattacttgcatcattatgatcgtgatgattgggagcaagaagcattgattatttgttacgaatctgtagtagttttttctggtaaaaaaggaagttttggtagtttatataaaactaagttatctaatcatgctcgaacgttagttaggtataatactgcgttgagaagacaaatatacaatcattctgtttctttagatagtaatttgtgtatacaagaacctggacgaagtgaattgataacgcccgttaaaactatatatcatgagtttatcgaaagcttgtctcgtctggaattaattgcggtattgacaatactaggcgaaattagtgtggaatacgtaattaataatttaaaaatagaatatatgcaattagttagggcgagatcaagagcaattcagaagatgagaaatgtattattc

SEQ ID NO: 26 - protein, 178 aa, Lactobacillus acidophilus
MCTEEKLINKAKMGDDQALKELFFLYKPLVNSILKKYYLHHYDRDDWEQEALIICYESVVVFSGKKGSFGSLYKTKLSNHARTLVRYNTALRRQIYNHSVSLDSNLCIQEPGRSELITPVKTIYHEFIESLSRLELIAVLTILGEISVEYVINNLKIEYMQLVRARSRAIQKMRNVLF

SEQ ID NO: 27 - DNA, 282 bp, Lactobacillus acidophilus
  CDS (1)...(282)
  misc_feature (0)...(0): ORF 405; GroES - Cochaperonin
ttgttacaaccaattggtgatcgcgtgatcgttaaagttaaagaagaagaagaaaagactgttggcggtattgttttagcatcaaatgctaagcaaaagccaactgaaggtgaagttgtagctgttggtgaaggtgcatacacttcaaatggtgacaaacttccaatggtcgttaagaagggcgacgttgttctttacgataagtactcaggcactaatgttgaatacgaaggtgaaaagtacttagtccttcatgaaaaagacattttagcaattgaaaag

SEQ ID NO: 28 - protein, 94 aa, Lactobacillus acidophilus
MLQPIGDRVIVKVKEEEEKTVGGIVLASNAKQKPTEGEVVAVGEGAYTSNGDKLPMVVKKGDVVLYDKYSGTNVEYEGEKYLVLHEKDILAIEK

SEQ ID NO: 29 - DNA, 1626 bp, Lactobacillus acidophilus
  CDS (1)...(1626)
  misc_feature (0)...(0): ORF 406; GroEL - 60 kDa chaperonin
atggcaaaagatattaaattcgcagaaaacgcaagacgttctcttttaaagggtgttgacaagttagctgataccgttaagactactattggtcctaagggtagaaacgttgttttggaacaaagttacggcaacccagacattactaatgatggtgttactattgctaagtcaattgaattaaaagaccattacgaaaacatgggtgctaagcttgttgctgaagctgcacaaaagactaacgacattgccggtgacggtactactactgcaactgttttgactcaagcaattgctcgtgaaggtatgaagaacgttactgctggtgctaaccctgtaggcattcgtcgcggtattgaaaaggcaactaaggctgctgttgatgaattacacaagattagccacaaggttgaatcaaaggaacaaattgctaacgtagctgctgtttcttcagcatctaaagaagttggtgaattgatcgctgacgctatggaaaaggttggtcacgatggtgttattactatcgaagattcacgtggtatcaatactgaactttcagtagttgaaggtatgcaattcgatcgtggttacttgtcacaatacatggtaactgacaacgacaagatggaagcagaccttgataacccatacatcttgattactgacaagaagatttcaaatattcaagacatcttgccacttcttcaagaaatcgttcaacaaggtaagtcattattgatcattgctgacgatgttactggtgaagctcttccaactcttgttttgaacaagattcgtggtactttcaacgttgtagctgttaaggcacctggttttggtgaccgtcgtaaagctcaacttgaagacattgcagcccttactggtggtacagtaattaccgatgacttaggctttgaattaaaggacactaagattgatcaattaggtcaagcacgtcgtgtaactgtaactaaggactcaactactattgttgacggtgctggttcaaaggacgctattaaggaacgcgaagattcaattagaaaacaaattgaagaatcaacttcagacttcgacaagaagaagttacaagaacgtcttgcaaaacttactggtggtgtggctgttatccacgtaggtgctgctactgaaactgaacttaaggaacgtcgttacagaatcgaagatgctttgaactcaactcgtgccgctgttgatgaaggctacgttgccggtggtggtactgcattagttgatgttgaaaaggcaattaaggaccttaagggtgaaacatcagatgaacaaactggtatcaacattgttttaagagcattatcagcacctgtacgtcaaattgctgaaaacgctggtaaagacggtgcagttgtattgaacaagcttgaaagccaagaaaacgaaattggttacaatgctgcaactgataagtgggaaaacatggttgaagctggtatcatcgacccaactaaggtaactcgtactgctttgcaaaatgctgcttcaattgctgctcttcttcttacaactgaagctgttgttgcagatattcctgaagataagccagaagctcctcaagcaggtgcagctggtgctccaggtatgggtatg

SEQ ID NO: 30 - protein, 542 aa, Lactobacillus acidophilus
MAKDIKFAENARRSLLKGVDKLADTVKTTIGPKGRNVVLEQSYGNPDITNDGVTIAKSIELKDHYENMGAKLVAEAAQKTNDIAGDGTTTATVLTQAIAREGMKNVTAGANPVGIRRGIEKATKAAVDELHKISHKVESKEQIANVAAVSSASKEVGELIADAMEKVGHDGVITIEDSRGINTELSVVEGMQFDRGYLSQYMVTDNDKMEADLDNPYILITDKKISNIQDILPLLQEIVQQGKSLLIIADDVTGEALPTLVLNKIRGTFNVVAVKAPGFGDRRKAQLEDIAALTGGTVITDDLGFELKDTKIDQLGQARRVTVTKDSTTIVDGAGSKDAIKEREDSIRKQIEESTSDFDKKKLQERLAKLTGGVAVIHVGAATETELKERRYRIEDALNSTRAAVDEGYVAGGGTALVDVEKAIKDLKGETSDEQTGINIVLRALSAPVRQIAENAGKDGAVVLNKLESQENEIGYNAATDKWENMVEAGIIDPTKVTRTALQNAASIAALLLTTEAVVADIPEDKPEAPQAGAAGAPGMGM

SEQ ID NO: 31 - DNA, 999 bp, Lactobacillus acidophilus
  CDS (1)...(999)
  misc_feature (0)...(0): ORF 431; PepRI - regulator with identity to CcpA
atgcataagcaagaagttacgatctatgatgtagctcgagaagcaaaggtttcaatggcaaccgtttctcgtgtcgttaatggaaataataatgttagaaaagaaacacgtgatcgtgttttagaagttattaagagattacactatcaaccaaatgcggtagcacaaggtttggcttctaaacgtacaactactgttggtttgattgtcccagatttaactaatttatattttgcggaattatctaaaggaattgatgatattgcacttttatacaagtacaacatcattattacaagtattgaaaatcgcttgatgaaagaagatcaagttattcagagtttgcttaacaagcaggttgatggcgtaatttatatgtcaaaccgtttgccagataaagcagcagaagcattcaatcgaacagatactccagttgttttagctggtaccaaagacaatcgtgaagaatttgcttctgttacaattgattacaaaaaagcagatacagaagctttgaatttgatgatgcatgatggcaagaagaatttagcaattgttgttggagatgaagacgcagttgttaacggtgaaaatagaattcctgcttatcaagaatttattaaagaaaataatttaggtgagccacatatttatacaggaataagagattattcagatggttataatttatacccacaacttgttaaagatggaattgatggtgtaattgttactcgcgacatttcatccgttggtattatgaattccgcaatggatgctggtaagaagattccagaagatttggaaatcgtgactgctagtgcaactcagcttgcttcagttgttcgtccagctttaactacaattaagcaaccactatatgatatgggagctgttgcaatgagaatgttgactaagctgatgaacaatgaagaagttgatgaaactcacattgaattgccatatgaattagtcaaaaagcaaagtactgcaaataga

SEQ ID NO: 32 - protein, 333 aa, Lactobacillus acidophilus
MHKQEVTIYDVAREAKVSMATVSRVVNGNNNVRKETRDRVLEVIKRLHYQPNAVAQGLASKRTTTVGLIVPDLTNLYFAELSKGIDDIALLYKYNIIITSIENRLMKEDQVIQSLLNKQVDGVIYMSNRLPDKAAEAFNRTDTPVVLAGTKDNREEFASVTIDYKKADTEALNLMMHDGKKNLAIVVGDEDAVVNGENRIPAYQEFIKENNLGEPHIYTGIRDYSDGYNLYPQLVKDGIDGVIVTRDISSVGIMNSAMDAGKKIPEDLEIVTASATQLASVVRPALTTIKQPLYDMGAVAMRMLTKLMNNEEVDETHIELPYELVKKQSTANR

SEQ ID NO: 33 - DNA, 882 bp, Lactobacillus acidophilus
  CDS (1)...(882)
  misc_feature (0)...(0): ORF 439; Putative thioredoxin reductase
ttgcatgggttaaatactatagtttttgattcattatctgaagtcggtggacagccacagatgctatatccttttaagcaaattaacgatattcctgcatataattcaattagtggaacagatttaattcaaaagctaaaacacgatatcaaaaatgaaactgaaattattaccaatcataaagttgtagatgtaactaaacaaagcgatggatttatcattgataatataatttatgcacgcagcattatcattgcaacaggtgccggtgcttttaagcctaaggaattacctctaaaaatcagcgatgaaataaaagaaaaaattcattattttgttaaagatcctagtcaatttaaaaatcaaactattggtgttttcggtggcggcgattcagcactagatttagctcttgaagtagcaaaatatgcgaatgttaaacttattcaccgtagagaccaatttcgcggtcttgaatcaaacgtaaaaaaattaaaatctttaaaaaacgttgaaattctaacaccgtatcttcctaaaaaaattgaattgatcaataatcaattagacattagtcttaaaaaaatgggtgttgagcaattaagaaacgtacaattagatcaaattgttgtagcttatggttttagagcaaataatagatttgctaaaaaatggggtatcaatttagagcaatcaaatattcccgtagatccaactatgaagacaaatatcgatgggatttatgctgctggagacgtagttacttatcccggacgtgttcccttgatagctttaggatttggtgaggcccaaattgcaattacatctatcatgcgcaatcttttcccagaaaaaagcttaacaatccattcaactagcatt

SEQ ID NO: 34 - protein, 294 aa, Lactobacillus acidophilus
MHGLNTIVFDSLSEVGGQPQMLYPFKQINDIPAYNSISGTDLIQKLKHDIKNETEIITNHKVVDVTKQSDGFIIDNIIYARSIIIATGAGAFKPKELPLKISDEIKEKIHYFVKDPSQFKNQTIGVFGGGDSALDLALEVAKYANVKLIHRRDQFRGLESNVKKLKSLKNVEILTPYLPKKIELINNQLDISLKKMGVEQLRNVQLDQIVVAYGFRANNRFAKKWGINLEQSNIPVDPTMKTNIDGIYAAGDVVTYPGRVPLIALGFGEAQIAITSIMRNLFPEKSLTIHSTSI

SEQ ID NO: 35 - DNA, 966 bp, Lactobacillus acidophilus
  CDS (1)...(966)
  misc_feature (0)...(0): ORF 676; HprK - bifunctional HPr kinase
atggctgatgaagtaaaattaagtaaattaattaaggataataagagtattcttgaagtttatcaaggacaagaatatgttaatgctaaaaaaatctatgtttcagatatttatcgtccggggctagaattaacaggatattttgatttttatcctgcacaacgtattcagttgttaggaagaactgaaatttcgtatgcagctagacttgatcatgagattagaactcatgtatttactaagatggctactaaagctaccccatgttttttaatttcacgttcgctaccagtacctgaagaattatccgaagcagcagaaaaagcaaatattcctattctacgtactagtgaatctactacttatatttctagtattctaactgaatatttgcgagcacgattagcaaagagaaatagtattcacggtgttttggttgaaattaaaggtatgggtgtactgttaactggtgcttctggtgtaggtaaatctgaaacagcacttggtttagttcaaagaggtcatagacttattgctgatgatcgtgtcgatgtttttcaaaaagatcataatacagttgtaggtgaagcacccaaaattctaagacacttaatggaaattagaggaattggaattatcgatgtcatgaatttgtttggcgcaggtgcagttaaaagcagaaccgaaattcaattagtaataaatttggttaactgggatcctaaagcaaattatgatcgtctaggttttcaagaaaatactcgcgaaatatgtaatgttgaaattccacaggttaatattccagttaaagttggtcgaaatattgaaattattattgaagtagctgctatgaactttagagctaaaaaaatgggatatgatgctactcaaatgtttgataataatttaactaacttaatttcagaacactcaaaagaagatacagataaggtgcaacatgatgac

SEQ ID NO: 36 - protein, 322 aa, Lactobacillus acidophilus
MADEVKLSKLIKDNKSILEVYQGQEYVNAKKIYVSDIYRPGLELTGYFDFYPAQRIQLLGRTEISYAARLDHEIRTHVFTKMATKATPCFLISRSLPVPEELSEAAEKANIPILRTSESTTYISSILTEYLRARLAKRNSIHGVLVEIKGMGVLLTGASGVGKSETALGLVQRGHRLIADDRVDVFQKDHNTVVGEAPKILRHLMEIRGIGIIDVMNLFGAGAVKSRTEIQLVINLVNWDPKANYDRLGFQENTREICNVEIPQVNIPVKVGRNIEIIIEVAAMNFRAKKMGYDATQMFDNNLTNLISEHSKEDTDKVQHDD

SEQ ID NO: 37 - DNA, 942 bp, Lactobacillus acidophilus
  CDS (1)...(942)
  misc_feature (0)...(0): ORF 679; Thioredoxin reductase - general stress protein 35/EC 1.6.4.5
gtgaaaggagcggcgaatatggccgataaatatgacgtaattgtaattggcgctggaccaggtggtatgacagcggctttatatgctacccgtgctaatttaaatgtattggtgcttgatcgtggaccatacggtggtcaaatgaacaatactgatgcaattgataattatccaggctttactgaagttaaaggaccagaacttagtcaaaagatgtatgatactttaatgaagtttgaacctgattataaatacggtaatgtacaatcagttgaattagatggagacgaaaaagttattaagactgacgatgaagaatatcgcgctccagtcttaattatcgctactggtgcagatcatagacacttgaatgttccaggtgaagaggaatactcaggtagaggagtttcttattgtgctgtttgtgatgctgcattttttaaggatgaagatgtggttgtagtgggtggcggtgattccgctatcgaagaaggaatttatctttctcaaatggccaagagcgtaactgttattcaccgtcgtgatcaattacgtgctcagcctactttgcaaaaacgtgcatttgcaaatgaaaaaatgaagttcatttggaatgctcaaacagaagaaattctaggtgatggtaatcgtgtaaccggtgttaagtatctagataaagaaaatggagaaactaaagaagtttctgctgcaggtgtatttatttatgtgggtgtgttaccacaaactgaaccatttaaaaaactaggtattttaaatgaacaaggttggattccaactaatgagcacatggaaacaaaagtatcaggtatttttgctttaggtgatgttcgtgataaagatttgcgtcaaattgctaatgcggttggtgaaggtagtgtagcggggcaggctgcatataattattttcaagatttaaaaaac

SEQ ID NO: 38 - protein, 314 aa, Lactobacillus acidophilus
MKGAANMADKYDVIVIGAGPGGMTAALYATRANLNVLVLDRGPYGGQMNNTDAIDNYPGFTEVKGPELSQKMYDTLMKFEPDYKYGNVQSVELDGDEKVIKTDDEEYRAPVLIIATGADHRHLNVPGEEEYSGRGVSYCAVCDAAFFKDEDVVVVGGGDSAIEEGIYLSQMAKSVTVIHRRDQLRAQPTLQKRAFANEKMKFIWNAQTEEILGDGNRVTGVKYLDKENGETKEVSAAGVFIYVGVLPQTEPFKKLGILNEQGWIPTNEHMETKVSGIFALGDVRDKDLRQIANAVGEGSVAGQAAYNYFQDLKN

SEQ ID NO: 39 - DNA, 585 bp, Lactobacillus acidophilus
  CDS (1)...(585)
  misc_feature (0)...(0): ORF 694; ClpP - ATP-dependent protease/proteolytic subunit
atgctagtacctacagttattgaacaaactgctcgtggtgaacgtgcctatgatatttactcacgtttattaaaagacagaattattatgttgagtggcgaaattaatgaccaaatggccaactcaattatcgcccaactacttttcttggatgcccaagacaatactaaagatatttcattatatattaactcaccaggtggtgtaatcacttctggtcttgcaatcatggataccatgaactttatcaagtcggatgtttctaccattgcaatcggtatggcagcatcaatggcttctattcttttgacaagtggtacaaagggtaagcgttttgcacttcctaactcaacagttcttattcaccaaccattaggtggtgcacaaggtcaacaaactgatattcaaattgcagctaatgaaattttgaagagtcgtaagaagatcaacgaaatcttgcacgaaactactggtcaacctttggaaaagatccaaaaagatactgaacgtgataattacttaactgctgaagaagctaaggaatatggcttaattgatgaaattatggtcaacaaaaaaagtaat

SEQ ID NO: 40 - protein, 195 aa, Lactobacillus acidophilus
MLVPTVIEQTARGERAYDIYSRLLKDRIIMLSGEINDQMANSIIAQLLFLDAQDNTKDISLYINSPGGVITSGLAIMDTMNFIKSDVSTIAIGMAASMASILLTSGTKGKRFALPNSTVLIHQPLGGAQGQQTDIQIAANEILKSRKKINEILHETTGQPLEKIQKDTERDNYLTAEEAKEYGLIDEIMVNKKSN

SEQ ID NO: 41 - DNA, 1014 bp, Lactobacillus acidophilus
  CDS (1)...(1014)
  misc_feature (0)...(0): ORF 698; Glyceraldehyde-3-phosphate dehydrogenase
atgacagttaaaattggtattaacggtttcggccgtattggtcgtttagcattccgtcgtattatggacttgggcgaaaagtcaaaggatatcgaagttgttgcaattaacgacttgactactccagcacttttggcacacttacttaagtatgactcaactcatggtactttcgaccacgaagtttcttcaactgaagattcaatcgtagttgacggtaagaagtaccgtgtttacgctgaaccacaagcacaaaacattccatgggttaaaaacgacggtgttgacttcgttcttgaatgtactggtttctacactagcaaggctaagtcacaagctcaccttgacgcaggtgttaagcgtgtattgatctcagcaccagcaggtaacgacttgaagactatcgtttactcagtaaaccaagatactttgactgctgacgacaagatcgtttcagctggttcatgtactactaactcattggcaccaatggttaacgctttacaaaaggaattcggtattgaagttggtactatgactactatccacgcatacacttcaactcaaatgatcttggatggtcctgtacgtggtggtaacttacgtgctgctcgtgctgctgctatcaacattattcctcactcaactggtgctgctaaggctatcggccttgttattccagaattgaacggtaagttgaacggtcacgcacaacgtgttccagttccagatggttcagtaactgaattagtatcaatcttgggcaagaacgttactgctgatgaagttaacgaagctatgaagaagtacgaaagtccttcatttgaatatgaaccaaacaatgttgtttcaagcgacattttaggcagaactgctggttcaatctttgacccaactcaaactatggtaactactgcaggtgacaagcaattagttaagactgttgcttggtacgacaatgaatactcattcacttgccaaatggttcgtactttgttacactttgctactctt

SEQ ID NO: 42 - protein, 338 aa, Lactobacillus acidophilus
MTVKIGINGFGRIGRLAFRRIMDLGEKSKDIEVVAINDLTTPALLAHLLKYDSTHGTFDHEVSSTEDSIVVDGKKYRVYAEPQAQNIPWVKNDGVDFVLECTGFYTSKAKSQAHLDAGVKRVLISAPAGNDLKTIVYSVNQDTLTADDKIVSAGSCTTNSLAPMVNALQKEFGIEVGTMTTIHAYTSTQMILDGPVRGGNLRAARAAAINIIPHSTGAAKAIGLVIPELNGKLNGHAQRVPVPDGSVTELVSILGKNVTADEVNEAMKKYESPSFEYEPNNVVSSDILGRTAGSIFDPTQTMVTTAGDKQLVKTVAWYDNEYSFTCQMVRTLLHFATL

SEQ ID NO: 43 - DNA, 462 bp, Lactobacillus acidophilus
  CDS (1)...(462)
  misc_feature (0)...(0): ORF 783; Universal stress protein
atgctttcacaatataagaatattcaagtttctgtcgatggctcaaaagaagccgatttagctttcagcaaggctgttgctattgccaagcgtaataatgcaacattagagattttacatgttattgatactcgttcatttcaaaatgtatctagctttgattcagcaatggttgaacaagtttctaaagatgcagaaaagagaatgaaagattatcaagctcgtgctgccaaagctggtgtaacagattcacactattcaatcgaatttggttcacctaagacaattattgctcgtgatttccctgagaagcataacattgatttaatcgttgtcggtgctaccggattaaacgctgttgaacgtctattaattggtagcgttactgaatatgtaactagaacttcaaaatgtgacgttttagtatgccgtgctgaagaaattgctgatgctttagaaaaa

SEQ ID NO: 44 - protein, 154 aa, Lactobacillus acidophilus
MLSQYKNIQVSVDGSKEADLAFSKAVAIAKRNNATLEILHVIDTRSFQNVSSFDSAMVEQVSKDAEKRMKDYQARAAKAGVTDSHYSIEFGSPKTIIARDFPEKHNIDLIVVGATGLNAVERLLIGSVTEYVTRTSKCDVLVCRAEEIADALEK

SEQ ID NO: 45 - DNA, 1242 bp, Lactobacillus acidophilus
  CDS (1)...(1242)
  misc_feature (0)...(0): ORF 833; FtsW- Cell division protein
gtggtgacttttttgttttataatgaaaaaagtattatttcacataaaggggcaacgctcgtgcgtcgaaaattaagatatcttaattaccgaattttaatcccatacttaattttagtagttgtaggaataattttggtatattcagcaagttcagacattttattagttaatggatttaagccagatgtttatggaattcgtcaagcaatctatgctgctgtagcattttttggatttggtattcctttttttgcattaaggctaaaggttattaaaaatccaaaatttgtagctggttttttaataatctgtattttaatgctgctatggttggtctttttaagatttgctcatggtagtgcagcagccgttaatggggctgttggttggattaacttgggtttcattaatcttcagccgttagaagttactaaattggctttagtaatttatttagcttatgttttggatcgaagagacggaaaattagtaaggggaaaaattaaagataatctatctcatcctgctatgctagctggtttcttaatgtgtttagttattgtagagcctgactttggtggtaccgcaattttattcatgattacgttagtaatgttttccgtatctggtgtaccagttaggttagcactaacttggctactcggaatcatactattagttggggcagtttttattttagtagttctttggaatcctaaatttttgcaggatagttatcaatttcaacgattgatgtcatttttacatccctttcaacttgaaagaaaaggtggagcccaattagttaattcttactatgcaatccataatggaggattgtttggtgtaggattagggaacagtatgcaaaaacgaggatatttgccagaaccatatactgattttattttatctattacagccgaagaaattggcgttatcttcacgattgtactggttggtctattattttatttaatgtggcaaattatggaagtaggtattaatgccgtctcacaatttgatgcattaatttgctttggcgtgacaacaattatttttactgaagcattgtttaatatcggtgctgtattaggtctattaccaattactggtgttacgctgccatttatttcgtatggtggttcttctatgatcgttttaactgctgcaattgggttagtgctgaatgtatctgctaatgaaaaaatgttaaaagaaaaggatgaaacaattgca

SEQ ID NO: 46 - protein, 414 aa, Lactobacillus acidophilus
MVTFLFYNEKSIISHKGATLVRRKLRYLNYRILIPYLILVVVGIILVYSASSDILLVNGFKPDVYGIRQAIYAAVAFFGFGIPFFALRLKVIKNPKFVAGFLIICILMLLWLVFLRFAHGSAAAVNGAVGWINLGFINLQPLEVTKLALVIYLAYVLDRRDGKLVRGKIKDNLSHPAMLAGFLMCLVIVEPDFGGTAILFMITLVMFSVSGVPVRLALTWLLGIILLVGAVFILVVLWNPKFLQDSYQFQRLMSFLHPFQLERKGGAQLVNSYYAIHNGGLFGVGLGNSMQKRGYLPEPYTDFILSITAEEIGVIFTIVLVGLLFYLMWQIMEVGINAVSQFDALICFGVTTIIFTEALFNIGAVLGLLPITGVTLPFISYGGSSMIVLTAAIGLVLNVSANEKMLKEKDETIA

SEQ ID NO: 47 - DNA, 1260 bp, Lactobacillus acidophilus
  CDS (1)...(1260)
  misc_feature (0)...(0): ORF 847; ClpX - ATP-dependent protease/ATP-binding subunit
atggcaaatcagtttacagatcaagaagagattaaatgtgctttttgtggtaaaactcaagaccaagttaaaaaaatgattgccggaaacggtgtatatatttgtaatgaatgtgttgacttggctaaaaaaattattgacgatgaattacgtgcagattcactaaaaactgcaagtgaactgcctaaaccagttgaaattaaaaaacaacttgatcaatatgtaattggtcaagatcgtgctaaaaaagtactatcagttgctgtttataatcactacaagagaatcagccaaatggatgtagattcatcaacagaattacaaaagtctaatattgcaatgattggtcctactggatcaggtaagacttatttagctcaaacacttgcacgtattttaaacgttccatttgcaattgctgatgcaaccacgttaactgaagctggatatgttggtgaagatgtagaaaacattttgcttaaattattacaaaatgctgattacgatcttgaacgagcacaacgtggaattatttatattgatgaaattgataagatttctaaaaaatctgaaaacgtatcaattacacgtgatgtttcaggtgaaggtgtgcaacaatcgcttttgaagattttggaaggtactattgcttctgtgcctcctcaaggtggacgaaagcatccgcaacaagaaatgataaagatggatactactaatattctctttattgtaggtggagcatttgatggaattgaacagattgttaaaagccgtttaggtaagaaaactattggttttggtgctgaaaacgaagttaacaaggtagatgctgatgattggactcgtcatttaactactgctgatttagttaaattcggtatgattccagaattcattggtagaattccaattattaccacgcttgataaacttgataataaagatttagttcgcgtattaactgagccaaagaatgctcttgttaagcaatataagaaacttctatcattagatggtgtagaattgaagtttactgatggtgcattaaaagcaattgctgatttagctatccaaagaaatatgggagctcgtggtttaagaacaatcattgaaaattcaattatggatattatgtatgaaaccccaagtgaagaagatattgaatcagtagaagtgactaaagacgtaataacccgtcacgcacagcctcgcattactcgtaaaaatgctgaagaagttcaggtaaaagcaaatgataat

SEQ ID NO: 48 - protein, 420 aa, Lactobacillus acidophilus
MANQFTDQEEIKCAFCGKTQDQVKKMIAGNGVYICNECVDLAKKIIDDELRADSLKTASELPKPVEIKKQLDQYVIGQDRAKKVLSVAVYNHYKRISQMDVDSSTELQKSNIAMIGPTGSGKTYLAQTLARILNVPFAIADATTLTEAGYVGEDVENILLKLLQNADYDLERAQRGIIYIDEIDKISKKSENVSITRDVSGEGVQQSLLKILEGTIASVPPQGGRKHPQQEMIKMDTTNILFIVGGAFDGIEQIVKSRLGKKTIGFGAENEVNKVDADDWTRHLTTADLVKFGMIPEFIGRIPIITTLDKLDNKDLVRVLTEPKNALVKQYKKLLSLDGVELKFTDGALKAIADLAIQRNMGARGLRTIIENSIMDIMYETPSEEDIESVEVTKDVITRHAQPRITRKNAEEVQVKANDN

SEQ ID NO: 49 - DNA, 1368 bp, Lactobacillus acidophilus
  CDS (1)...(1368)
  misc_feature (0)...(0): ORF 851; LysA - Diaminopimelate decarboxylase/EC 4.1.1.20
ttgcttggcgcaggcagtggattttttattagcgtttcgcctgcacgaacgggagagaaaagcatgaatccacaaattatggaaaaacaagttaatgaaaaagggcatttaacaattggcggtgttgatactcttgaacttgcgaagaaatatggtacgccgttagttgtatatgatgtaaatcgaatccgtaatcaaattagggcttttaaaaaagtatttgaagaagaaggcgttagttatgctgtgagttatgctagcaaagcatttgcctgtattgctatgtatcaagtagccaatgaagaaggtgcatatactgatgttgtttcggctggagaattgtatactgcattgaaagccggctttccagcagaaaaaattagttttcatggtaataataaatctttagctgaaattgaaatggcagttaaaaatcatgtaggaaagattattattgataattttcatgagattgaactgctagatcaggtattgcaccaatatgatacccaaataaatgttatgttgcgaatcactccaggaatttcggcacatactcatgaatatgatcaaaccggtcaaattgatagtaaatttggctttgatctagaatcaggacaggcagatttagcattagagcgagttttagctaattcgagaatgaatatgttaggtattcatgctcatataggatcacaaatttttgaattaaatggttttgaattagctgctaaaaagttaatggaagtagcagaaaattggcgtagccaatatggatatacagcaaaaataattaatgtaggtggcggttttggcatcaaatatactgctgatgataatccgttaaaacctgaagaattcgtaagaacaattattgaaacaataaaaaaaggatcagctgatgctgcttttccaactccagaaattgatattgaacctggtcgttcaattgtaggtcctgctggatataacttatatactgtgggaagttgtaaaactattccaagttatagtccatatgttgccgtagatggtggtatgggtgacaatattcgtcctgcgttatatcaagcaaaatatgatgtggttttagcaaataatcctaaggcgccagtcgttaatcgcgtgaggatcgcaggtaaatattgtgagagtggcgatattttagctaccgaatcattaccagaagttaaatctggtgacgtactagcaatgctggatacaggagcatacggatattcaatggcgtcgaattataatcgaaatcctcgaccagctgtagtttttgcagaaaacagaaaagcgcacttagtcgtcaaaagagaaagtttagaagatctagttcatttagacaggttttgtaaggaa

SEQ ID NO: 50 - protein, 456 aa, Lactobacillus acidophilus
MLGAGSGFFISVSPARTGEKSMNPQIMEKQVNEKGHLTIGGVDTLELAKKYGTPLVVYDVNRIRNQIRAFKKVFEEEGVSYAVSYASKAFACIAMYQVANEEGAYTDVVSAGELYTALKAGFPAEKISFHGNNKSLAEIEMAVKNHVGKIIIDNFHEIELLDQVLHQYDTQINVMLRITPGISAHTHEYDQTGQIDSKFGFDLESGQADLALERVLANSRMNMLGIHAHIGSQIFELNGFELAAKKLMEVAENWRSQYGYTAKIINVGGGFGIKYTADDNPLKPEEFVRTIIETIKKGSADAAFPTPEIDIEPGRSIVGPAGYNLYTVGSCKTIPSYSPYVAVDGGMGDNIRPALYQAKYDVVLANNPKAPVVNRVRIAGKYCESGDILATESLPEVKSGDVLAMLDTGAYGYSMASNYNRNPRPAVVFAENRKAHLVVKRESLEDLVHLDRFCKE

SEQ ID NO: 51 - DNA, 801 bp, Lactobacillus acidophilus
  CDS (1)...(801)
  misc_feature (0)...(0): ORF 867; Transcriptional regulator
atgaaaattggtgaagctttaaaaaaagaaagaaaaagtcattttttattacaaaaagatatggttaaagacttaaatatttctaaatcacattattctcagatagaaagtgggaaacatcgtgtatatacagacgatttactgaaaatgctgattagtaatgatattgattatcgaaccttttttgatgaagtagttacgagttatggctttgatgaaattagaagtagattggaaacggctttgacaaaagccttttatgagaggaatttggataatgccgttaaaattaaaaaagaaataatgatgtccaaccaagtatcagttgaattaaagtatcatgcatttttagtggtagctgaaataagcaatactcaaatttcagattctattaaaaaagaaatacaaaattttttgtttaaagatgataattggactgaacaccgtgatgcgctaagattatttggaaatgcaatgaaatattttgatccagaggctagaagtgtgctaatgaattctgttctaaaaaaatacaaaaatataaatacattttcaaaagtaacccaaattagaattttaacgatttatataaattatttgttcaattataaaggaagaatagataaaactataaaagatataattcaagagattaaattagtggatccccaaccgcaatatttaatttataagctattaggaacatattttgaattaaaatatcagggggatgaatcaagtgcagagttgataaaaacgactctatcactagcaggatacaataaaattgtaaaacaacta

SEQ ID NO: 52 - protein, 267 aa, Lactobacillus acidophilus
MKIGEALKKERKSHFLLQKDMVKDLNISKSHYSQIESGKHRVYTDDLLKMLISNDIDYRTFFDEVVTSYGFDEIRSRLETALTKAFYERNLDNAVKIKKEIMMSNQVSVELKYHAFLVVAEISNTQISDSIKKEIQNFLFKDDNWTEHRDALRLFGNAMKYFDPEARSVLMNSVLKKYKNINTFSKVTQIRILTIYINYLFNYKGRIDKTIKDIIQEIKLVDPQPQYLIYKLLGTYFELKYQGDESSAELIKTTLSLAGYNKIVKQL

SEQ ID NO: 53 - DNA, 2247 bp, Lactobacillus acidophilus
  CDS (1)...(2247)
  misc_feature (0)...(0): ORF 932; RelA - ppGpp synthetase/involved in starvation response/EC 2.7.6.5
atgaccaaaatgtctaaatatgttgaaatgacgcatgatcaagtaattgatacttgtaaaaagtatatgaatgaagatcaagttgcctttgttgaaagagcatatgaatttgctaataaagctcatgctggacaaaagcgggcatccggacaaccttatattattcacccaactcaagttgctggtacattagccaatttaggacttgatccagatacgattgccgctggttttttacatgataccgtagaagatacgccagtaactaatgatgaattaaaagaaaaatttggtgaggatgttgctttcatcgtcgatggtgtaactaagctaaataagtatgaatataattctcaccaagaatttttagctgaaaatcaccgtaaaatgttgattgcaatggctaaagatttacgagttattatggttaaattagctgaccgtttgcataatatgcatactttacaacatttgcgtcctgataagcaaagacgaattgcttcagaaacgatggatatttatgcaccattagctgatcgtttaggtatcggaacaattaagtgggaattagaagatatgagtttccactacttaaatcctgaagcatattaccgtattgttaacttaatggatgtcaaaagaagtcaacgtgagaaatatatttctgatactattaagactttgaagaaaacacttgatgagttgggaattaaatacgatatttatggtcgaccaaagcatatttattctatctataaaaagatggtaaataagcataaggactttgatgaaatttatgatttgcttgcagttcgtgtaattgttaaaaacgttcgtgattgttatgctgttttgggtgctgttcatactgaatggaaaccaatgccaggtagatttaaagattatattgcgatgcctaaggtcaacggatatcaatcacttcatactacgattattggaccaggtggtcgtccacttgaaattcagattaggaccgagcaaatgcatgaagttgctgaatacggtgttgctgctcactgggcatataagcgtggtaatttcaatggggttgaagcaacgtcgtcaggtgaaaagctggatatggttcgtgaaattctagaattaaaggatgagactaaggacgccggcgagttcatgaagtcagttaaaagtgatatcttttctgatcgtgtgtatgtctttactccaaaaggtgaggtatatgaattgcctaagggatcagttacattagattttgcttatgcaattcatactcaagtaggtagtcatgccgttggtgctagagtaaataataaattagtaccacttgattataaattaagaaatggcgatgtaattgagattatgacgcagaccaatgcggctccatcacgtgattgggcggatatggttaagacgtcaagagctcgtaacaagattcgtcgttactttagaggtcaagaccgtgaagaaagtatcgagcatggtgagcaaatggtggctaataccattcgtgatgaaggactcgtgccgaaagacttcatggataaagagcatattgaaaaattacttgaacattttaattacaatacttctgaagagttatacgcagcagtaggttttggtgatctgtcagcacaagcggttgttaatagattaacaattgatttgcgtcgtgaagatgaaaaacaaaagcaaaaagaactagaagaaaagattttgaattctggtcagcaggcaattaaagaagaacaacctaagaaaaattcaaattctgtcatgaaagttaagcataagaatggagtaatgattcaaggcgttagtgatttaatgctccatttagctaaatgttgtaatccggttcctggagatgaaattattggttacgtcactaaaggacgtggagtgactattcaccgaacagattgtagaaatataactaaggaagcggaagaacaaggtcgattgattgatgttgaatgggagaacgttgaagaaaacaatgttcaatcatttaatgcaaatattgaggtctttggctataatcgttctaatttgcttagcgatgtaatcaataaattgaactcattaactaaaaatattaataatatttctggtaaagttaatgatgataacattgcgcatatttatgtgactgttgctgttagaaatgcaaagcaacttgatgaaattttaagcaaattgcgtgatattcctgatgtatatgaaacaaagaggtcagacaat

SEQ ID NO: 54 - protein, 749 aa, Lactobacillus acidophilus
MTKMSKYVEMTHDQVIDTCKKYMNEDQVAFVERAYEFANKAHAGQKRASGQPYIIHPTQVAGTLANLGLDPDTIAAGFLHDTVEDTPVTNDELKEKFGEDVAFIVDGVTKLNKYEYNSHQEFLAENHRKMLIAMAKDLRVIMVKLADRLHNMHTLQHLRPDKQRRIASETMDIYAPLADRLGIGTIKWELEDMSFHYLNPEAYYRIVNLMDVKRSQREKYISDTIKTLKKTLDELGIKYDIYGRPKHIYSIYKKMVNKHKDFDEIYDLLAVRVIVKNVRDCYAVLGAVHTEWKPMPGRFKDYIAMPKVNGYQSLHTTIIGPGGRPLEIQIRTEQMHEVAEYGVAAHWAYKRGNFNGVEATSSGEKLDMVREILELKDETKDAGEFMKSVKSDIFSDRVYVFTPKGEVYELPKGSVTLDFAYAIHTQVGSHAVGARVNNKLVPLDYKLRNGDVIEIMTQTNAAPSRDWADMVKTSRARNKIRRYFRGQDREESIEHGEQMVANTIRDEGLVPKDFMDKEHIEKLLEHFNYNTSEELYAAVGFGDLSAQAVVNRLTIDLRREDEKQKQKELEEKILNSGQQAIKEEQPKKNSNSVMKVKHKNGVMIQGVSDLMLHLAKCCNPVPGDEIIGYVTKGRGVTIHRTDCRNITKEAEEQGRLIDVEWENVEENNVQSFNANIEVFGYNRSNLLSDVINKLNSLTKNINNISGKVNDDNIAHIYVTVAVRNAKQLDEILSKLRDIPDVYETKRSDN

SEQ ID NO: 55 - DNA, 522 bp, Lactobacillus acidophilus
  CDS (1)...(522)
  misc_feature (0)...(0): ORF 984; HslV - ATP-dependent protease
atgacaacaatttgttcagtaagatttaatggaaaaacagctattgctggagatggtcaagttactttaggtgaaaaagtaattgctaaggcaactgcaagaaaaattcgtcgtatttaccatgatcgtgtagttatcggctttgccggtggtgttgcggatgctgtaagtttacaagatatgcttgaaggaaagcttgaaagttatagtggtgatttacgccgtgctgctgttgaaatggcacaagcatggcgtaaagatccaactttgcaaaaattaaacgcaatgctgatcgcttttgatgataaagatcttcttttgatttcaggaaatggtgaggttcttgaacctgatgaaaatgttgtagcgattggttcaggtggtaatttcgctcaagctgcagccattgcaatgacacgtcatgctaaagaaatgaaagccgatgagatcgcacatgaagcagttaagattgcgtcaggtattgacgtgtttactgatgatcatattgttactgatgaaatt

SEQ ID NO: 56 - protein, 174 aa, Lactobacillus acidophilus
MTTICSVRFNGKTAIAGDGQVTLGEKVIAKATARKIRRIYHDRVVIGFAGGVADAVSLQDMLEGKLESYSGDLRRAAVEMAQAWRKDPTLQKLNAMLIAFDDKDLLLISGNGEVLEPDENVVAIGSGGNFAQAAAIAMTRHAKEMKADEIAHEAVKIASGIDVFTDDHIVTDEI

SEQ ID NO: 57 - DNA, 1398 bp, Lactobacillus acidophilus
  CDS (1)...(1398)
  misc_feature (0)...(0): ORF 985; HslU/HtpO - heat-shock induced protein
atggctataaagaccccaaaagaaatagttaaaatcttaaatgaatatattattggccaagatgaagcaaaaaaatctgtagcgattgctttgtataatcgctatcgtagaatgcaattgccaaaacaaatgcaacgtgaaatcacacctaagaacttacttatggctggtcctaccggtgtaggtaaaactgaaattgctcgccgcttagctacaattgttgaagctccatttgttaaggttgaagcaactaaatttactgaagttggttatgttggtcgtgacgttgaatcaatggtgcgtgacttagttggcgaagccgttaggatggaagaaaaagaccaatttgcacgtgtaaaacctcaagctactaaagaggctaataaagaattagttcgtttgcttgcacctggcgaaaagcgtgaaaaacgtgagaatcaagtacaacagatgcaagatatgatgtccatgttaatgggtggaatgaataaccaaactaataataaccaagaggaaattagtgaagaagttcgtaaccaaagaatggacgtagctgaaaaattaaataaggatcttcttgaagaccgtgaggttactattgaagttgagcaagctcccaaagctaatccaatgagcgatatgatgggacaaatgggcatggacatgggctcaatgcttaatgacattatgcctaaaaagaaggttaagcgtactttaccagttagagaagcacgtgaagttttaattcaagaagaatcacgtaaattagttgactatgatactatttaccaacgtgcaattgaacgaagccaaaataatggtattatatttatcgacgaaattgataagattattgctggtaataagcgtaattctggtgaagtttctcgtgaaggtgtacaaagagatattttgccaatcgttgaaggttcaacagttaatacaaaatatggtcctgtttcaaccgatcatattttattcattgcagctggtgcatttgctgaaagtaaaccaagtgatttaattcctgaacttcaaggtcgttttccaattagagtagaacttaacgctttaactaaagatgattttgttaagatcttgaaggacccacaaaactcacttttaaagcaatatattgcactgcttaaagctgacggaattaaattgatttttactcaagaagcagttgataaaattgcagaaattgccttcgatgttaaccaaggaactgataatatcggtgcaagacgcctttctactattttagaaaagttgcttgaagatgttctttacgaagggccagatatggaaatgggtgaaattactattactgaagcttatgttgaagaaaagcttggtgatatcatcatgaataaggatttaactaagtttattctt

SEQ ID NO: 58 - protein, 466 aa, Lactobacillus acidophilus
MAIKTPKEIVKILNEYIIGQDEAKKSVAIALYNRYRRMQLPKQMQREITPKNLLMAGPTGVGKTEIARRLATIVEAPFVKVEATKFTEVGYVGRDVESMVRDLVGEAVRMEEKDQFARVKPQATKEANKELVRLLAPGEKREKRENQVQQMQDMMSMLMGGMNNQTNNNQEEISEEVRNQRMDVAEKLNKDLLEDREVTIEVEQAPKANPMSDMMGQMGMDMGSMLNDIMPKKKVKRTLPVREAREVLIQEESRKLVDYDTIYQRAIERSQNNGIIFIDEIDKIIAGNKRNSGEVSREGVQRDILPIVEGSTVNTKYGPVSTDHILFIAAGAFAESKPSDLIPELQGRFPIRVELNALTKDDFVKILKDPQNSLLKQYIALLKADGIKLIFTQEAVDKIAEIAFDVNQGTDNIGARRLSTILEKLLEDVLYEGPDMEMGEITITEAYVEEKLGDIIMNKDLTKFIL

SEQ ID NO: 59 - DNA, 1485 bp, Lactobacillus acidophilus
  CDS (1)...(1485)
  misc_feature (0)...(0): ORF 995; Amino acid permease
ttggaggaaaatttcatgtcagaagaaattgaaactattaatttcgaacccggcaaaaagcattatatgagttggccagtcattgctttgattgactttgttactattattagttttgaaaatattttttatccatttcaaaaccaaggattatccgttgttgtttcttggatcttccttttatttgcttatgttattccttatgctttgatgtgtagtcaaatggggttgacttttaaagatcaagcaggtggacttgcttcttgggttcgtcattcatcaaatgatactttaggttattggacctcttggatgtattgggtacaaaccgtcccttatctagttgacgtatccaattcagttattgtttcattctcttggattattttaggcaataatactttagacaagcacatgtctactttctggttcggaatcttaacatttgtaattattttggcttttatcctgatagaaaatgctattaagaactcacttgagcttctttctttaatcggtgggggtgccatgttcattatgtctatgctgtttgtcttacttgcagcttgggccgttatgcatggtcatcatattgctactcagccatttaacttaagtgcatttaaaccatcgtttagtttgagatatttctcaactactggtttattgatttttgctatgtctggtgctgaacttgctgcgccttacattgtacaaatgcgagatccaaaacacgaatttcctaaagcaatgtggatgctagctattatgactggctttttaaccatctttggtactttagcattagcactcttctttaatgctcaccatattccacacgactttaagatgaacggaccttactatgctttccaacttttaggggaaagtttaggctggggtaaagtcttaatgtacatctttgccgtcgttcaagccatctttatgatggcacaattagccgtgttactagatgcatctagtcgtgtattcgcaggtgacgttgccgataagtacatgcctaagtggcttaccggcaaaaaggacaagacaggacgtccgatccactcttacactttgacttgtggcttggctttattcttgcttttacttactggtactttaccaaatatcaattctatttataattggttattaaacattaacggtattatttcaccatacaaaacttgttgggtattctttgcttttatcatgatgcgtatgcaccaaaagaaatttcattccgattatgtttttataaaaaatagaacgggtgccctaatcatgggttggtggtgcttaatcttcactttcatctgtgctaccttaggttttatccctcaagaagcagaagctacatttggtagtaccgcatttaatcaccaattgatcatgaatatcatcacagttaccgtactctttggattaggcttcttattgccttggctacgtagacgtgaagaaaaacgtgaaatgaatata

SEQ ID NO: 60 - protein, 495 aa, Lactobacillus acidophilus
MEENFMSEEIETINFEPGKKHYMSWPVIALIDFVTIISFENIFYPFQNQGLSVVVSWIFLLFAYVIPYALMCSQMGLTFKDQAGGLASWVRHSSNDTLGYWTSWMYWVQTVPYLVDVSNSVIVSFSWIILGNNTLDKHMSTFWFGILTFVIILAFILIENAIKNSLELLSLIGGGAMFIMSMLFVLLAAWAVMHGHHIATQPFNLSAFKPSFSLRYFSTTGLLIFAMSGAELAAPYIVQMRDPKHEFPKAMWMLAIMTGFLTIFGTLALALFFNAHHIPHDFKMNGPYYAFQLLGESLGWGKVLMYIFAVVQAIFMMAQLAVLLDASSRVFAGDVADKYMPKWLTGKKDKTGRPIHSYTLTCGLALFLLLLTGTLPNINSIYNWLLNINGIISPYKTCWVFFAFIMMRMHQKKFHSDYVFIKNRTGALIMGWWCLIFTFICATLGFIPQEAEATFGSTAFNHQLIMNIITVTVLFGLGFLLPWLRRREEKREMNI

SEQ ID NO: 61 - DNA, 2091 bp, Lactobacillus acidophilus
  CDS (1)...(2091)
  misc_feature (0)...(0): ORF 996; Ornithine decarboxylase
atggattttttaaaaatagctattggaaataatgttagtatcgataaattaaaagattggacattagttccaattggtcaagctgaaaatagtgcggagcttgcagctattgtcattaagcaaaatgatatcttagctaaattaaaagctgatgaattaaaaaaacaatctgggtttccgattcctgtgattgaagtagagcagcaagttgattcaaaagtaaaacaagatataattcaaaaagcggagaactatcaacatgaaatggtgcccggttttttaactgatttgattaatttcgctcaggctaaaccgattagttttactacgccgggtcaccataatggtcaataccttgatttgcatcccgctggtgtagtattcaataggttctttggcaagaatatgatgtttgcagatacaagcgataccgttcctcaattgggtgatacgatgactcatacgggtacaccacttgacgcagagaaaaaggcggcagaaacttatcatgctgataaagtgtatttctgtacgaatggtacaactagtgctaattctatctgtgcaagtgcgcttttgtctgaaggtgatttagtattatttgaccgtaataatcacaagtccttatacaatagcgcattagttatgagcggtgctaagcctgtatatattccaactgatcgcaatgctttgggattaattggcgaaatggaccctgactttttaacagaagataaaattagagctgaaattgccaaagttgatccaaaaaaagctaaattaaagcgtccattcagattagccattgtgcaagctgaaacttatgatggtatattttatgatgctaagtggattcttgatcgaatcggaaaactttgtgactacatcttattcgattgtgcatggggcggatttgaagaatttgttccaattatgaaacacttatcaccattactccttaacctagggcctgatgatcctggtattttggtaactcaatcactgcacaagcaacaagttggtatggctcaggcttctcaaattttgaagaaggactcccatattcaaggccaaaagcgctatgttgaccacaagcactttaaccatgaatacttgaagtttgttacttcttcatatgcctatccactttatgcatctttgactgttaactcttatgttactgctggtgaaggtaacaaaaagtggtgggatgaaatcttgcgtatgggtattgaatggcgtaaggaacttctaaagaagtctaaattatttaagccatttgttccagttaactttttagatattccgactaatgaattggcaactaatgctaagtattggaatatgagcaaagaagataattggcatgggtttactaagatgggtaaaggcgaagcaatgatcgatccactcaagattacggtaaaaactcctggtattgatgtccagaatgctaaatatgaagaaacaggtattccaggtgcagttgtagcagaattcttgatggaaaatcatattattcgtgcaaagaacgacttgaattcgcttttgttcttgctaacaccaggtgatactaaagaagaacttgataccttgcttgatgcatttttgaagtttgaaaagtattataacgatgatggtttggtaaaggatgtccttccagttttgtacaaagaatatcctgatcgctacaagggctacactgttaagcatctttgtcaagaaatgcacgaatactataaagaaaataatacttttgttttgcagcaagaactatttgaaaagccggggatgcaagattacaagatgactcctgcagaagctgatcaaatgtttaagcgtaatgaaaataaagtagtcaaccttgaagatgtggtaggtgaaaccgcagctgaaggtgctttgccatatccaccgggagtctttattgtagctcctggtgaaaagtggggcacaattgatcaaaagtacttcgaagttttggcacatgcaattgaaaaatttccaggttttgtgccagaaattcaaggagtatatttggatcaaaatgctgatggtacgttgagagtacaagctgaagttattaagaaa

SEQ ID NO: 62 - protein, 697 aa, Lactobacillus acidophilus
MDFLKIAIGNNVSIDKLKDWTLVPIGQAENSAELAAIVIKQNDILAKLKADELKKQSGFPIPVIEVEQQVDSKVKQDIIQKAENYQHEMVPGFLTDLINFAQAKPISFTTPGHHNGQYLDLHPAGVVFNRFFGKNMMFADTSDTVPQLGDTMTHTGTPLDAEKKAAETYHADKVYFCTNGTTSANSICASALLSEGDLVLFDRNNHKSLYNSALVMSGAKPVYIPTDRNALGLIGEMDPDFLTEDKIRAEIAKVDPKKAKLKRPFRLAIVQAETYDGIFYDAKWILDRIGKLCDYILFDCAWGGFEEFVPIMKHLSPLLLNLGPDDPGILVTQSLHKQQVGMAQASQILKKDSHIQGQKRYVDHKHFNHEYLKFVTSSYAYPLYASLTVNSYVTAGEGNKKWWDEILRMGIEWRKELLKKSKLFKPFVPVNFLDIPTNELATNAKYWNMSKEDNWHGFTKMGKGEAMIDPLKITVKTPGIDVQNAKYEETGIPGAVVAEFLMENHIIRAKNDLNSLLFLLTPGDTKEELDTLLDAFLKFEKYYNDDGLVKDVLPVLYKEYPDRYKGYTVKHLCQEMHEYYKENNTFVLQQELFEKPGMQDYKMTPAEADQMFKRNENKVVNLEDVVGETAAEGALPYPPGVFIVAPGEKWGTIDQKYFEVLAHAIEKFPGFVPEIQGVYLDQNADGTLRVQAEVIKK

SEQ ID NO: 63 - DNA, 2001 bp, Lactobacillus acidophilus
  CDS (1)...(2001)
  misc_feature (0)...(0): ORF 1012; Beta-glucoside specific PTS system
ttgacaacttgtatatacaagtttaatataatagctaaatctaatgaaaacgctttatacaggagaaaaacaatgaatgaaaacaatgaaattgcaattctcgctcccgcaagcggtgaagtaattgcattaagtaaaacaagtgatccaatctttagtaaaggtgcaatgggacaaggatttggtcttacaccatctgatggtgaagttgttgcaccaataagtggaaaagtttcaatgattgcagatactaaacatgctattggaataaccacagatgatgggcttgaagtattagttcacatgggagttgatacagttagtcttaagggagagccttttgaagttttagttaaaaatggtcaaactattgaagccgggcaagatattgccacaatgaatcttaaagccattaaaagtagcaatcttgatactaccattatggttttaatcacaaactcaaatgataagcttgagggtttagacgtttctgaaggtcctgctagaactggcgacgttatagctcatgcatacctaaaagtagaacaaaagaatacctcaaatcaaaagctttcatatgatgaactggcaacttttatcataaaaaatgttgggggcaaagataatattaacaatttaattcactgtatcactcgtctacgcttctacttgaaagatgaaagtaaagctaatgacgaagcattaaagaatcaacgtggtattcttgatgttatgcatgctggtggtcaatatcaagttgttatcggaaatgaagttactaatgtttatgatgcagtaatgaaacagcttcctaatttaagtgatcaacctgctccacaaactaatgaaaatgatgaccgtaatcctgtttcaaaggcatttggcaacttgatcggctttattactggttcaatgagtccagtaattggcgtaatcgctgcatcaggtattattaaaggatttttggctttactcactcttccacaacttggagcattattaaacgttaaaagtcctgtctatataacagttagtgcaatggctgactcagcattcttcttcctaccaattttagttggattctcggctgctaaacgacttaatagtgatccaattattgcagctgtaattggtggttttattacttatccccaaatgattagttggggtactgcgggtaagatgatgtttaatctaggtaattggaacttccaattcttaaactacagttactcaatctttccaatgatcttggctgcatggcttgctgctaaatgcgaagattggcttaagaaaattttaccaagctatttacaaatgattttcgtaccattaattactattttagctgtatcaaccatcactttagtaattacggggccagttattcaaggtgctgctaacggcatcgcagtatttattaattggttagtatcatcatcaggttggatcggcggcttagtaatcggtgccttttaccaactacttgttatcttcggtcttcactggggtgttgtaccactggtcgctcaacaaattgcttctactggtcaaagttcattaaatgcaattatttgttcaactatgatcgctcaaggtgctgccgttttagctgttgcagttaagtcaaagaaggctgacatgaaagaattaggtattgcagctgctatctcagcattctgcggtgttaccgaaccagcgatttatggaattaacttaagatacaagaaagtttttgcttcaggctgtgtcggttcagcatttggtggtcttgtaaccggtcttatgcatggtacaatgtacggttttactggtggtctaattggattttctagtttcttcaatccggctcatcctactcaactaaacagtttctacacattcttaatcgctagtgctgtttctattgtggttgcattcattgttacctgggtttggggctataatgataatatgaccatgggtaaaaaagttgaaaagaaacaacgtccaggtactaag

SEQ ID NO: 64 - protein, 667 aa, Lactobacillus acidophilus
MTTCIYKFNIIAKSNENALYRRKTMNENNEIAILAPASGEVIALSKTSDPIFSKGAMGQGFGLTPSDGEVVAPISGKVSMIADTKHAIGITTDDGLEVLVHMGVDTVSLKGEPFEVLVKNGQTIEAGQDIATMNLKAIKSSNLDTTIMVLITNSNDKLEGLDVSEGPARTGDVIAHAYLKVEQKNTSNQKLSYDELATFIIKNVGGKDNINNLIHCITRLRFYLKDESKANDEALKNQRGILDVMHAGGQYQVVIGNEVTNVYDAVMKQLPNLSDQPAPQTNENDDRNPVSKAFGNLIGFITGSMSPVIGVIAASGIIKGFLALLTLPQLGALLNVKSPVYITVSAMADSAFFFLPILVGFSAAKRLNSDPIIAAVIGGFITYPQMISWGTAGKMMFNLGNWNFQFLNYSYSIFPMILAAWLAAKCEDWLKKILPSYLQMIFVPLITILAVSTITLVITGPVIQGAANGIAVFINWLVSSSGWIGGLVIGAFYQLLVIFGLHWGVVPLVAQQIASTGQSSLNAIICSTMIAQGAAVLAVAVKSKKADMKELGIAAAISAFCGVTEPAIYGINLRYKKVFASGCVGSAFGGLVTGLMHGTMYGFTGGLIGFSSFFNPAHPTQLNSFYTFLIASAVSIVVAFIVTWVWGYNDNMTMGKKVEKKQRPGTK

SEQ ID NO: 65 - DNA, 723 bp, Lactobacillus acidophilus
  CDS (1)...(723)
  misc_feature (0)...(0): ORF 1013; Trehalose operon transcriptional repressor
atgacggaatcaaaatcagacattattgcacaagatattgctgctaaaatacagcatcaacaatttaaagctggtgagttacttccaagtgagagtcaattaacaacactatatggtacatctcgcgagacagttcgtaaggcgttgaatcaattaactgcgttgggtctaatacaaaaaatacgtggaaaaggttcaatagttttaaatttagaaaaatattcttttcctatttctggaattactagtttcgctgaattgaataaatctttaaacatgcatgcagaaacaaaagtaatcacattaaaaaagatggttgatttaccagaattttttaaggaaaaatttccagagcaaaaaaggcaaccaggaatctatgttgaaagattgcgtgtagttaataatgagcctgtcgtattagattgtgattatttgttttcaccaccaattgatgaattaccaaaagaggcagcagaaaaatctatttatgattatattgaaaataaacttaaattagatatttcatatgctacaaaggtaattacagttgaaaaaattgatgataaatttaaaaagttattacaactggatgatagtttagctgtattagtagccagtcataatttcttgaatgacactacgttattccaattgacattatctttccataatccaagtaaatttaaatttgttgattttgcaagaagacagaagattaaattg

SEQ ID NO: 66 - protein, 241 aa, Lactobacillus acidophilus
MTESKSDIIAQDIAAKIQHQQFKAGELLPSESQLTTLYGTSRETVRKALNQLTALGLIQKIRGKGSIVLNLEKYSFPISGITSFAELNKSLNMHAETKVITLKKMVDLPEFFKEKFPEQKRQPGIYVERLRVVNNEPVVLDCDYLFSPPIDELPKEAAEKSIYDYIENKLKLDISYATKVITVEKIDDKFKKLLQLDDSLAVLVASHNFLNDTTLFQLTLSFHNPSKFKFVDFARRQKIKL

SEQ ID NO: 67 - DNA, 1710 bp, Lactobacillus acidophilus
  CDS (1)...(1710)
  misc_feature (0)...(0): ORF 1014; Trehalose 6-P hydrolase
ttgttgattttgcaagaagacagaagattaaattgtaaggagaaaagtatgattaatttaggcaaaaaaataatttatcaaatttatcctaaatctttctatgattcaaatggcgatggggtaggagatcttcaaggaatcattcaaaagattgattatattaagaagttaaatgtagacatgatctggtttaatccattttttgtttcaccgcaaaatgataatggttatgatattgctgattattacaacattgatcctcgctttggtacaatggctgattttgagaaattggtaaagaagctgaaagaaatcggtgtgggtgtaatgctagatatggtgctcaatcactgctcaactgaaaatatttggtttaaaaaagcacttgctggcaatgaaaagtatcgtaaatttttctacttgagaaaaggaaaaaacggaggtttacctaataattggcaaagtaaattcggtggtactgcttggtcaaaatttggtgataccgattactactaccttcacttgtatgatccaactcaagcagatcttgattggcataatcctgaagttcgtaaagaattatttaaagtggttaacttttggcgtagtaaaggtgtccatggcttccgctttgatgtaattaatgttacgggtaaagcggaaaaactagttgattcaacagatcctgtagaagaaaagagtttgtacactgatactccaattgttcataaatacttaaaagagcttaatgctgcaacttttggtcaagaccctgaatcaattactgtgggagaaatgtcatcaacgacgattgccaactcaattgaatattcaaaaccaagtgaacatgaattatcaatggttttcactttccatcatttgaaagttgactatcaggatggtgaaaagtggtctaagatgccatttgattttatgaaattaaaggaattattcactgaatggcaagaaaaaatggatcaaggtgatggctggaacgcattattctgggacaatcatgatcagccttgggcattaactagatttggtgatactggtaagtatcgtggaaagtcagctgaaatgcttgccacagcaactcatcttatgcggggaacaccatatatttatatgggtgaagaaattggtatgattgatcctgattattcttcaatggatgattacgtagatgttgaggccaagaatgcttttaaggctttaactaaaaaaggtttgagtgataaagaagcttttgaaatagttaaatcaaaagctcgtgacaattcacgtgtaccaatgcattggaatagtgaaaaatatgcaggttttagtgaacataagccgtggctcataccaactgatcaagaaaaaattaatgttgaagaggaattagcacatggtgaaatttttaattactatcaaaagttaattaagctgcgtagaagcgaagatttaatctctgatggtcatattaagatgttcttgaaagatgatccgcaggtttttgcttatgaacgctacttaaaagatagtgataaaaagttattggtatttactaacttctatggtaaagaacatagtgttaaattacccgaagaatatcaaaacaaagaataccaagttttaattaacaattatgatactaaagatagccaattaaccgatgaaattatattgaagccatatgaagcattagctattaaaattaaacaa

SEQ ID NO: 68 - protein, 570 aa, Lactobacillus acidophilus
MLILQEDRRLNCKEKSMINLGKKIIYQIYPKSFYDSNGDGVGDLQGIIQKIDYIKKLNVDMIWFNPFFVSPQNDNGYDIADYYNIDPRFGTMADFEKLVKKLKEIGVGVMLDMVLNHCSTENIWFKKALAGNEKYRKFFYLRKGKNGGLPNNWQSKFGGTAWSKFGDTDYYYLHLYDPTQADLDWHNPEVRKELFKVVNFWRSKGVHGFRFDVINVTGKAEKLVDSTDPVEEKSLYTDTPIVHKYLKELNAATFGQDPESITVGEMSSTTIANSIEYSKPSEHELSMVFTFHHLKVDYQDGEKWSKMPFDFMKLKELFTEWQEKMDQGDGWNALFWDNHDQPWALTRFGDTGKYRGKSAEMLATATHLMRGTPYIYMGEEIGMIDPDYSSMDDYVDVEAKNAFKALTKKGLSDKEAFEIVKSKARDNSRVPMHWNSEKYAGFSEHKPWLIPTDQEKINVEEELAHGEIFNYYQKLIKLRRSEDLISDGHIKMFLKDDPQVFAYERYLKDSDKKLLVFTNFYGKEHSVKLPEEYQNKEYQVLINNYDTKDSQLTDEIILKPYEALAIKIKQ

SEQ ID NO: 69 - DNA, 492 bp, Lactobacillus acidophilus
  CDS (1)...(492)
  misc_feature (0)...(0): ORF 1047; Probable thiol peroxidase/superoxide-indicible protein 8
atgaaaattacttttaaaggtaaagaagttaaattagtaggtactccgccagcagttagagaagaaatgcccaactttacagtactagataagaataatcaagaatttactaagtctgatttgctaggcaagtttagtttgattagtgtagtaccaaatatcaatactcctgtttgcagtattcaaaccaaaacttttaataaggcaatggataaattcccagaaattaactttttgactatttccaccaatactattgaagaccagcaaacttggtgtgctgccgaagacgttaaaaatatgaaattgatgtctgataaaaatttgtcatttggtaaagcgaccggtttattaattccagaattcggcatccttgctcgttctgtttgggttctcgaccctaattgtaaaatcctatatcgtgaattagttgatgaaattacacatgaacctaattatgatgcagttttaaacgaattaaaacaattgcat

SEQ ID NO: 70 - protein, 164 aa, Lactobacillus acidophilus
MKITFKGKEVKLVGTPPAVREEMPNFTVLDKNNQEFTKSDLLGKFSLISVVPNINTPVCSIQTKTFNKAMDKFPEINFLTISTNTIEDQQTWCAAEDVKNMKLMSDKNLSFGKATGLLIPEFGILARSVWVLDPNCKILYRELVDEITHEPNYDAVLNELKQLH

SEQ ID NO: 71 - DNA, 1329 bp, Lactobacillus acidophilus
  CDS (1)...(1329)
  misc_feature (0)...(0): ORF 1107; Glutathione reductase/EC 1.6.4.2
atgaaaaaatatgattacattattttaggtagtggccctgtcgcaattcacttgcttgctaagcttgaaagaacgacaaataaagttttattaattgaaaaaggcttatggggtggtacttgcccaaatacgggatgccaacctaaaatttttatggaaggtacagttcgccctgttttaaatagctattatttagctggaaaaggaatcaaagaagcagctaaaattgactggcctacattagtggctagaaaaaagaagatttggacagcctttcacaaaaacgaacgtaaaagcatgactagtgaacatactgatactgttcaaggaaaaggtgtgattactggaccacatacagtaaaagttggcgatcaagaatatgaaggtaaaaatattgtgattggaacaggtttggctccacgtgatcttgatgttccaggtaatgaatatgcaattaccaacaatgaattctttgatttagataaattacctaaacgcgcaatcgttattggtggtggttacgtggcaatggaattagctactattttgcaagcagctggtgcagaagtaaccatcttacaacattcagatcgattgctccgtccatttgatcaagaaatggttggaacgttgaaacgtattatggaagacaggggtatcaaattccatttgaatgctccagttaaagaaattgctaaagatggtgatcaatacacagttacaactgagaatggcgatacttttgatactgatttagtcattaatgcagcaggtagaaagcctaatgttgaaggaataggcttagaagatgttggtatcgaatttgatccaaataaaggtattaaagttaatgaacatatgcaaactaatattccaagcatctttgcggcaggagatgtagctgataacggtcaaccaagcttaaccccagttgcgtgggtagatgcatatcatattattaattttgttgaaaatggtattactgatcctatccaatatccacctgtagctactaacgcatttacttatccagaaattgctcaagtcggaatttgtgaagatgaaatggaagaaggagactacattaaaaccttagatttaagtgatatgttcttctcaatgggtgaaggtgattctcatgctaagctaaaggtaatccttaataagaatggtgaagtacgtggtgcttcagaattaagtattcatgctgctgaagacatcaataacttcgttccattagttggtagaaaagatcctaaaaaatttgtagaagaaaatttaacctttgcctttccaactccagcaaataatttggacacattatttcgt

SEQ ID NO: 72 - protein, 443 aa, Lactobacillus acidophilus
MKKYDYIILGSGPVAIHLLAKLERTTNKVLLIEKGLWGGTCPNTGCQPKIFMEGTVRPVLNSYYLAGKGIKEAAKIDWPTLVARKKKIWTAFHKNERKSMTSEHTDTVQGKGVITGPHTVKVGDQEYEGKNIVIGTGLAPRDLDVPGNEYAITNNEFFDLDKLPKRAIVIGGGYVAMELATILQAAGAEVTILQHSDRLLRPFDQEMVGTLKRIMEDRGIKFHLNAPVKEIAKDGDQYTVTTENGDTFDTDLVINAAGRKPNVEGIGLEDVGIEFDPNKGIKVNEHMQTNIPSIFAAGDVADNGQPSLTPVAWVDAYHIINFVENGITDPIQYPPVATNAFTYPEIAQVGICEDEMEEGDYIKTLDLSDMFFSMGEGDSHAKLKVILNKNGEVRGASELSIHAAEDINNFVPLVGRKDPKKFVEENLTFAFPTPANNLDTLFR

SEQ ID NO: 73 - DNA, 957 bp, Lactobacillus acidophilus
  CDS (1)...(957)
  misc_feature (0)...(0): ORF 1203; Phosphate starvation-inducible protein
ttggctcaaacagtttttacacctcaaaaaccagagaatattcaaaaattagttggagttaatgatggaaatttaaagcttctttctaaaggctatgatttgtctgtttcagatactggtaatgaaattgttattacaggtaatgatgaggcaaacattaaaaaagctatcgaagttttgaaagcattagacagtgtcgtgaataccggcgttaacgttggtgcgcccgacacagttagcgcgatgaaaatggcggataaaggtactactgagtactttgctgacttatacaagaaggttttgattcgggatgctaaaggtagaccgatcagagtcaaaaatatgggtcaaaagcgttatgttgaagccattaataaatctgacgttgttttcggaattggaccagctgggactggtaagacttttttagcagttgtatgtgcaattgcagcatttaaaaagggcgaagtttctagaataattttaacaagaccggccgttgaagctggtgaatcacttggatttttacctggtgatttgaaagaaaaagttgatccatatttgagaccaatttatgattcgttatatgcaattcttggtactaatactactgatcgtttaatggaaagaggagttattgaagtagctccacttgcttatatgcgtgggagaactcttgatgatgccttcgttattctagatgaagcccaaaacactaccgatgcacaaatgaagatgtttttgacacgtcttggctttaattccaagatggtcgtaaatggagatatgacgcaagttgatttgccgggacgacagcatagcggtttaatcgatgcgcggcacattttgaaaaatattgaccaaatcaaattcatcaacttttctgcaaatgacgttgttcgtcaccctgtagttgccaaaattattactgcttatgaaaaagaggacattaaacac

SEQ ID NO: 74 - protein, 319 aa, Lactobacillus acidophilus
MAQTVFTPQKPENIQKLVGVNDGNLKLLSKGYDLSVSDTGNEIVITGNDEANIKKAIEVLKALDSVVNTGVNVGAPDTVSAMKMADKGTTEYFADLYKKVLIRDAKGRPIRVKNMGQKRYVEAINKSDVVFGIGPAGTGKTFLAVVCAIAAFKKGEVSRIILTRPAVEAGESLGFLPGDLKEKVDPYLRPIYDSLYAILGTNTTDRLMERGVIEVAPLAYMRGRTLDDAFVILDEAQNTTDAQMKMFLTRLGFNSKMVVNGDMTQVDLPGRQHSGLIDARHILKNIDQIKFINFSANDVVRHPVVAKIITAYEKEDIKH

SEQ ID NO: 75 - DNA, 786 bp, Lactobacillus acidophilus
  CDS (1)...(786)
  misc_feature (0)...(0): ORF 1237; MetA - Homoserine O-succinyltransferase
ttggctaacaaagttaaaataggtatccttaatttaatgcatgataaactcgatacacaaagtcattttatcaaagtcttgcctaatgcagatctaacgttcttttatccacgtatgcattatcaaaatcgtcctattccacccgaagtaaatatgacttcagaacctctggatattaaccgagtgagtgaatttgacggatttatcattacaggtgcaccaattgaccaaattgatttttcaaaaattacttatattgaggaaatccgatatttgcttcaagccttagataatcacaagattcagcaattatatttttgctggggtgccatggctgctttgaattacttttatggtattaaaaagaaaattttagcagagaaaatctttggtgtttttcctcacttaatcacggaaccgcatcccctattaagtggacttagtcaaggttttatggctcctcatgctcgttatgcagaaatggataaaaagcagatcatgcaagatgaacgactagcaattaatgcagttgatgataatagtcatctttttatggtatctgcgaaagataatcccgaacgtaattttatcttttcacatatcgaatatggtaaagatagtttgagagatgaatataatcgcgaaataaacgctcatcctgagcgacattataaaaagccaataaattattcgatgtctaatccatcatttcaatggcaagatacacaaaaaatatttttcaataactggcttaaaaaggttaaagataataaattagttttaaat

SEQ ID NO: 76 - protein, 262 aa, Lactobacillus acidophilus
MANKVKIGILNLMHDKLDTQSHFIKVLPNADLTFFYPRMHYQNRPIPPEVNMTSEPLDINRVSEFDGFIITGAPIDQIDFSKITYIEEIRYLLQALDNHKIQQLYFCWGAMAALNYFYGIKKKILAEKIFGVFPHLITEPHPLLSGLSQGFMAPHARYAEMDKKQIMQDERLAINAVDDNSHLFMVSAKDNPERNFIFSHIEYGKDSLRDEYNREINAHPERHYKKPINYSMSNPSFQWQDTQKIFFNNWLKKVKDNKLVLN

SEQ ID NO: 77 - DNA, 1152 bp, Lactobacillus acidophilus
  CDS (1)...(1152)
  misc_feature (0)...(0): ORF 1246; DnaJ chaperone protein
atggcacaagaagattactacaaagtacttggcgtagatcgtgacgccagtgatcaagaaattagtaaagcatatcgtaagttagcgaaaaaatatcacccagacttgaatcatgaacctggtgcagaagaaaaatacaagcaagtaaacgaagcttatgaagttttacacgataagcaaaagcgtgcacagtatgatcaatttggctctgctggtgtcaatggtcaaggtggctttggtggtgcaggtcaaggattcgggggagctgggtttgatacctctggttttggcgactttggtgacatttttggtgatatctttggtcaaggtgctcgtcagcaaagggtagatccaacgcaaccacaacgtggtcaagatttggattatacattgactattgactttatggatgcaattaatggtaaaaagacgcaagttagctatactcgtgatgaaacttgtgaaacctgtggcggtaatggttgtgaaaaaggtactcatcctattacatgtgataaatgtcatggtactggtgtaatgactgttacccaacaatcaatgctaggtatgattcgtcgccaaaccacttgtgacaagtgtaatggacgtggtgtaattattgaacatccatgtaagacttgcggtggtaaaggtaccgttgaacgcaagaataccattgaagttgatattccagcgggtattgacaatggtcaacaacttcgttatcaaggtcaaggtgaagctggacgtaatggtggcccatacggtgatttgtatattagctatcgcattaagccttctaaggactttgaacgtcgtggccaaaatatttatacagaagtaccaatttcatttgctcaagctactttaggtgatgagattactgttaaaacagttcacggggatgcaaaattaactattccagcaggtacgcaacctaacaagaaatttactcttcgtggtcaaggtgtaccttatcttcgcggcaatggtaatggtgatcaaattactacagttaatattgttattccaaaacatattaatgataagcagaaagaagacttaactaactttgttcatgatggtggcggaaatattaccccacaagaaaaaggatttttcgaaagacttaaagacaaacttagtggtgaa

SEQ ID NO: 78 - protein, 384 aa, Lactobacillus acidophilus
MAQEDYYKVLGVDRDASDQEISKAYRKLAKKYHPDLNHEPGAEEKYKQVNEAYEVLHDKQKRAQYDQFGSAGVNGQGGFGGAGQGFGGAGFDTSGFGDFGDIFGDIFGQGARQQRVDPTQPQRGQDLDYTLTIDFMDAINGKKTQVSYTRDETCETCGGNGCEKGTHPITCDKCHGTGVMTVTQQSMLGMIRRQTTCDKCNGRGVIIEHPCKTCGGKGTVERKNTIEVDIPAGIDNGQQLRYQGQGEAGRNGGPYGDLYISYRIKPSKDFERRGQNIYTEVPISFAQATLGDEITVKTVHGDAKLTIPAGTQPNKKFTLRGQGVPYLRGNGNGDQITTVNIVIPKHINDKQKEDLTNFVHDGGGNITPQEKGFFERLKDKLSGE

SEQ ID NO: 79 - DNA, 1842 bp, Lactobacillus acidophilus
  CDS (1)...(1842)
  misc_feature (0)...(0): ORF 1247; DnaK - Heat shock protein 70
atgtcaaaagttattggtattgacctcggaactactaactcagcagttgcagttcttgaaggtaaagaacctaagattattactaatccagaaggtaatcgtactactccatctgtagttgcatttaaagatggtgaaattcaagttggtgaagtagcaaagcgtcaagctattactaaccctaacactattgtttcaattaagcgtcacatgggtgaagctgattacaaggttaaggttggcgacaagagctatacaccacaagaaatttctgcatttattttgcaatacattaagaagttttcagaagattacttaggtgaagaagttaaagacgcagttattactgttcctgcttacttcaacgatgctcaacgtcaagctactaaagatgctggtaagatcgctggtttaaatgttcaaagaattatcaacgaaccaactgcttcagcattggcttacggcttggacaaagatgatgacgacgaaaaggttttagtatatgaccttggtggtggtactttcgacgtttccgttcttcaattaggtgacggtgtcttccaagtattgtcaactaacggtgatactcaccttggtggtgacgactttgataaccgtattatggattggcttattaagaactttaaggatgaaaatggcgttgacttatctaaggataagatggctatgcaacgcttaaaggatgcatcagaaaaagctaagaaagacttgtcaggtgtatcatcaactcacatttcacttccatttatttctgcaggtgaaagtggtccacttcaccttgaagctgatttgactcgtgctaagtttgatgaattaactaatgacttggtagaaaagactaagattccatttgacaatgcattaaaggacgcaggccttactgttaacgatattgataaggttatcttaaacggtggttcaactcgtattcccgctgtacaaaaggcagttaaggaatgggctggcaaggaacctgaccactcaattaatcctgatgaagctgtagcattaggtgcagctattcaaggtggtgttatctcaggtgacgttaaagacattgttttacttgatgttactccattatcacttggtattgaaactatgggtggtgtgttcaccaaattaattgacagaaacactactattccaacttcaaagagtcaaatcttctcaactgctgcagataatcaaccagctgtagatgttcatgtattacaaggtgaacgtccaatggctgcagatgataagacacttggtcgatttgaattaactgatattccacctgcaccacgtggcgttcctcaaattcaagttacctttgatatcgataagaatggtatcgtaaatgtatctgctaaggatatgggtactggtaaggaacaaaagattaccattaagagttcatctggtttatcagatgaagaaatcaagcgtatgcaaaaagacgctgaagaacacgctgaagaagacaagaaacgtaaagatgaagcagatctcagaaatgaagttgatcaattgatctttacaactgaaaagactttgaaggaaactaagggtaaggtatctgacgaagatactaagaaggttcaagaagctcttgatgacttgaagaaagctcaaaaagataataacttggacgaaatgaaagaaaagaaagatgctttatcaaaagctgctcaagatttagctgttaagctttaccaacaaaatggtggtgctcaaggtgcagctggtcaagcaggtcctcaaggcggcaacccaaatgatggtaacaatggtggtgcccaagatggtgaattccataaggtagatcctaacaag

SEQ ID NO: 80 - protein, 614 aa, Lactobacillus acidophilus
MSKVIGIDLGTTNSAVAVLEGKEPKIITNPEGNRTTPSVVAFKDGEIQVGEVAKRQAITNPNTIVSIKRHMGEADYKVKVGDKSYTPQEISAFILQYIKKFSEDYLGEEVKDAVITVPAYFNDAQRQATKDAGKIAGLNVQRIINEPTASALAYGLDKDDDDEKVLVYDLGGGTFDVSVLQLGDGVFQVLSTNGDTHLGGDDFDNRIMDWLIKNFKDENGVDLSKDKMAMQRLKDASEKAKKDLSGVSSTHISLPFISAGESGPLHLEADLTRAKFDELTNDLVEKTKIPFDNALKDAGLTVNDIDKVILNGGSTRIPAVQKAVKEWAGKEPDHSINPDEAVALGAAIQGGVISGDVKDIVLLDVTPLSLGIETMGGVFTKLIDRNTTIPTSKSQIFSTAADNQPAVDVHVLQGERPMAADDKTLGRFELTDIPPAPRGVPQIQVTFDIDKNGIVNVSAKDMGTGKEQKITIKSSSGLSDEEIKRMQKDAEEHAEEDKKRKDEADLRNEVDQLIFTTEKTLKETKGKVSDEDTKKVQEALDDLKKAQKDNNLDEMKEKKDALSKAAQDLAVKLYQQNGGAQGAAGQAGPQGGNPNDGNNGGAQDGEFHKVDPNK

SEQ ID NO: 81 - DNA, 582 bp, Lactobacillus acidophilus
  CDS (1)...(582)
  misc_feature (0)...(0): ORF 1248; GrpE - Cochaperonin/HSP-70 co-factor
gtgagtaaagaagagtttccaagtgaaaaaaatttggataaagaagaaaacacttctaagcctaaaaaagcagtgaaaaaagaagcggctaaaggcgaagaaacaaaaaagaataatgaaaatcagaagttagctaaagaaatagctgatttaaaagaaaaaaataaagacttagaagataagtatttgcgtagtgaagcggaaattcaaaatatgcaaaaccgttataccaaagaacgtgcgcaacttatcaaatatgaatctcaaagcttagctaaagatgttttgcctgcaatggacaatttggaaagagcgttaagtgtagaagccgatgatgatgtatctaaacaattgaaaaagggtgttcaaatgacccttgatgcacttgttaaagcaatgaaagatcacggtgttgttgagattgaggctgatggcgttaaatttgatccgacattacatcaagctgtgcaaaccgtagcagctgaaaatgatgatcaaaaagatcacgtcgttcaagttttacaaaaaggatatcaatataaggatcgtacactaagaccagcaatggttgtagttgcacaa

SEQ ID NO: 82 - protein, 194 aa, Lactobacillus acidophilus
MSKEEFPSEKNLDKEENTSKPKKAVKKEAAKGEETKKNNENQKLAKEIADLKEKNKDLEDKYLRSEAEIQNMQNRYTKERAQLIKYESQSLAKDVLPAMDNLERALSVEADDDVSKQLKKGVQMTLDALVKAMKDHGVVEIEADGVKFDPTLHQAVQTVAAENDDQKDHVVQVLQKGYQYKDRTLRPAMVVVAQ

SEQ ID NO: 83 - DNA, 1047 bp, Lactobacillus acidophilus
  CDS (1)...(1047)
  misc_feature (0)...(0): ORF 1249; HrcA - Heat-inducible transcriptional repressor
atgttgaccgaacgtcaagaacttattttaaaaacgataattatggacttcacacagacacatgaaccagttggttctaagacagtgatgaatcagttgccaatcaaagtatcaagtgcgactattcgcaatgaaatggcagttctagaagatcaggggctaattgaaaaaactcactcttctagtggccgtattccttcaagtgaaggatatcgctattatcttgataacttggttgagccgcttaaattaccggagtccgtttataatacaattggaagtcaactagatcgaccttttcatcaggtaaacgaaattgtccaagaagcggcaagaattttatcagatttaaccaattatactgcatttgctgaaggacctgagaaacgtgacgttaaagttacaggctttagaattgttccattatcctcaagacaggtaatggcaattctggtcacaagtgatggcaatgttcagaaccaggtttatgctttacctcataatatttatggggaagaaattgaaaaagctgttcatatgattaatgatcagttagttggtaagagtttaaacgaaataaatgtttctttacttagtgaacttgctaaaagtgagctaggcggagaacatgtgactgagctgcttagtttagttgaagacgttttaaaagatgctgcgagtgagcagatgtatgttgatggacaaataaatctattaaataatacatctgagcataatgtgaaggatattcgttcactttatgaattgatcgatcatgataatttgttttctaatttgatggatagtaaagcagattccaaagataaaaattatccaattaaagttaaattaggatcagaattaccaaatgatttattaaaaaattacagtttgctgactgctgaatataatgttggttctcatggtaaagggacaattgctttattaggtccaactaacatgccatattcgcagatgatcggacttctagaatatttcagaaatgaattagctaagaagttacttgattattacggcaaatttcaa

SEQ ID NO: 84 - protein, 349 aa, Lactobacillus acidophilus
MLTERQELILKTIIMDFTQTHEPVGSKTVMNQLPIKVSSATIRNEMAVLEDQGLIEKTHSSSGRIPSSEGYRYYLDNLVEPLKLPESVYNTIGSQLDRPFHQVNEIVQEAARILSDLTNYTAFAEGPEKRDVKVTGFRIVPLSSRQVMAILVTSDGNVQNQVYALPHNIYGEEIEKAVHMINDQLVGKSLNEINVSLLSELAKSELGGEHVTELLSLVEDVLKDAASEQMYVDGQINLLNNTSEHNVKDIRSLYELIDHDNLFSNLMDSKADSKDKNYPIKVKLGSELPNDLLKNYSLLTAEYNVGSHGKGTIALLGPTNMPYSQMIGLLEYFRNELAKKLLDYYGKFQ

SEQ ID NO: 85 - DNA, 363 bp, Lactobacillus acidophilus
  CDS (1)...(363)
  misc_feature (0)...(0): ORF 1254; Putative ribosome binding factor A
atgaagcatagagttggtcgcgttgaaggtgaaatccttcgcgaattaacaaaaattttacgtaaagatattcgtgatccacgtttgagcgaagtaactattactgcggttgaatgtacgaatgatctttcatatgcaactatttactatagtttgttaactgaagatgctgaaaaagaaaaagaagttcaggaaggtttagataaggcaaaaggaatgatgagacatttgcttggacaaactttaactgtttacaaagttcctgaacttatctttaagcgtgataattcagtaaaatatggtagtaaaattgaccgtttaattgcagaagtcaaaaaacaagatgctgaacgggcaagtaaa

SEQ ID NO: 86 - protein, 121 aa, Lactobacillus acidophilus
MKHRVGRVEGEILRELTKILRKDIRDPRLSEVTITAVECTNDLSYATIYYSLLTEDAEKEKEVQEGLDKAKGMMRHLLGQTLTVYKVPELIFKRDNSVKYGSKIDRLIAEVKKQDAERASK

SEQ ID NO: 87 - DNA, 2649 bp, Lactobacillus acidophilus
  CDS (1)...(2649)
  misc_feature (0)...(0): ORF 1255; Translation initiation factor
atgaaggagtgtgattggatggcaaaaaaaagaatttatgaagtcgcaaaagaagtcggcgttgataataaagttgtagtccaaaaagcaaaggatttgggctttgatgtgaagaatcatatgtcgtcaatagatgattcacaagttgcgaagctaaagagtagtttccagaactccgctcctgctgaaaaaaaagcagaaaagtcagccactaagaataataaaattaagatttcagtttcttcaattcgaaaaaatgaaaagaaaccagaggaaaataatactcctaagaaatcaaatagaagacgtaataataaacgtcgttctagtgatcgagctcgggataataaagaacgtgatgcaaaatctaatacaggtagaccaaaagcagcagctttgcttcaacaatttaagcaaaagcaacgtgcagaagaaggtcagcttaatagagaagctcaaaaagcaaagaaagaatatcatgagcatttgaagcatcctaaaaaagagcagtcagaaaaagataataagaaaacagtaaaagaaagtaataacaaaaaagtagagcaacaagtggaaaagaaagtaatcggaccaaaaatcttaaaaccatcaccagcccgtttaaagaaaaatcaacctgcagataataaggaaaaagttactactcctagagtaactattcctgaagcaccaaaggaagaaaaacgtggtaacggtcgtggcagaaatatgggtaagccaggacgcaaaggaaagaatcaatttgttaatggacatagtgaacgttcagaccgttcagagagaaaacgtcgtaaaaataagaaacatcaacaggaacagcaaaagcctagaaaacaaattaccaaacgtaaggaacgtccattaccagatatattagtatatgaagaaggtatgaacgctcaagatatcggtaaattgattcaccgagaaccagctgaaattgttaagaaattattcatgcttggtgttatgactaatcaaaaccaatcattggataaagatactattgaacttttagctgctgaatatggtattgatgctaagcaaaaagttcatgaagatatttctgatattgatactctttacgacaagagaatggaagcttcaaagaagtctaaaaaccaaattaagcgcccacctgtagttactattatgggtcacgttgaccatggtaaaacgactttgttggaccgtcttcgtcatactcacgtttcagctcatgaagctggtggcattactcaaagaatcggtgcttaccaagttagacttgacgatcgtttgattacattcttagatactccaggacatgctgccttttctaatatgcgtgcacgtggtgctgaaattactgatattgttgtattggttgtagctgcggatgatggtgtaatgcctcagactgttgaagctattgaccacgctaagagtgctaatgttccaatcattgttgctattaacaagatggacaagccaggtgctaacccacaacacgtaactgaagaattaatgaagtataatttaattcctgaagattacggtggtgacacaattttcgttaacatttcagctaagacaggtcaaaatgtagatgatttattgcaaatgatcttacttcaagctgacgtgatggaacttaaggctaacccagatgaaatggcaatcggtactgtaattgaagcacgtttgtcacgtggtcgtggtccagttgccgacgttttgatccaacaaggtacacttaatattggtgatccgattgttgtaggtgatacttttggtcgtgtacgtactatgactaacgatcgtggtcgccaagttaagaaggctacaccatcagagcctgttgaaattactggtttgaatgatgtgcctgaatctgctgacaagttagttgaatttaaggacgaaaagactgcaagaagtgttggtgaagctagagctcaacaatcattgcaaaagtctcgtgaaaatgttcaacatgtaactcttgataacctcttcgatactatgaagaaggaaaacatgaaggaagttgacattgttcttaaggcagatgttcaaggttcagtagaagcattgcaacaatcacttgaaaagattgaagttgaaggtgttcgtgtaaacattatccactcaggtgtaggtgcaattaatgaatcagatgtaactttagctggtgcatctaatgcctttattattggatttaatgttcgtccaactgctactgcaaaaagtcaagcagaaactgacggtgtagatattcgtttatacagtatcatttacaaggctattgatgatgttaccgctgccatgaagggtatgcttgaacctacttatgaagaaaaggttattggtaatcttactgttcgtgaaacttggaaggtttcaaaggttggtacaattgccggatcatttgttgataaaggtatagtcaagaatgattctaaaattagagttattcgtgacggtattgttaagtatgacggtgaaattgcctcacttaagagattcaaggatgacgttaaagaagttaaacaaggtaatgactgcggtttaactattaaggattacaacgatattaaagtcggcgacgaattcgaagtatacgaaatgcaacaagttgaacctaag

SEQ ID NO: 88 - protein, 883 aa, Lactobacillus acidophilus
MKECDWMAKKRIYEVAKEVGVDNKVVVQKAKDLGFDVKNHMSSIDDSQVAKLKSSFQNSAPAEKKAEKSATKNNKIKISVSSIRKNEKKPEENNTPKKSNRRRNNKRRSSDRARDNKERDAKSNTGRPKAAALLQQFKQKQRAEEGQLNREAQKAKKEYHEHLKHPKKEQSEKDNKKTVKESNNKKVEQQVEKKVIGPKILKPSPARLKKNQPADNKEKVTTPRVTIPEAPKEEKRGNGRGRNMGKPGRKGKNQFVNGHSERSDRSERKRRKNKKHQQEQQKPRKQITKRKERPLPDILVYEEGMNAQDIGKLIHREPAEIVKKLFMLGVMTNQNQSLDKDTIELLAAEYGIDAKQKVHEDISDIDTLYDKRMEASKKSKNQIKRPPVVTIMGHVDHGKTTLLDRLRHTHVSAHEAGGITQRIGAYQVRLDDRLITFLDTPGHAAFSNMRARGAEITDIVVLVVAADDGVMPQTVEAIDHAKSANVPIIVAINKMDKPGANPQHVTEELMKYNLIPEDYGGDTIFVNISAKTGQNVDDLLQMILLQADVMELKANPDEMAIGTVIEARLSRGRGPVADVLIQQGTLNIGDPIVVGDTFGRVRTMTNDRGRQVKKATPSEPVEITGLNDVPESADKLVEFKDEKTARSVGEARAQQSLQKSRENVQHVTLDNLFDTMKKENMKEVDIVLKADVQGSVEALQQSLEKIEVEGVRVNIIHSGVGAINESDVTLAGASNAFIIGFNVRPTATAKSQAETDGVDIRLYSIIYKAIDDVTAAMKGMLEPTYEEKVIGNLTVRETWKVSKVGTIAGSFVDKGIVKNDSKIRVIRDGIVKYDGEIASLKRFKDDVKEVKQGNDCGLTIKDYNDIKVGDEFEVYEMQQVEPK

SEQ ID NO: 89 - DNA, 309 bp, Lactobacillus acidophilus
  CDS (1)...(309)
  misc_feature (0)...(0): ORF 1256; Ribosomal protein
ttgcagaatagacaaaaagcaattaatttattaggtttagctaagcgagctggtaagttaacaactggtacagaaactgtaattggtgagcttaataaaggaaaaataaaagcggtcattatggcaagtgatatacatgataatactgccgaaaaagttgatcgtgttgccagaagaaataatattcctataataaatttgtttactgccgatgaactttcaaaggcaatcggcaaaaaacgaaaagttttaggattaactgatgctggttttactaaggcattagttaagaaaataaatgaaggagtg

SEQ ID NO: 90 - protein, 103 aa, Lactobacillus acidophilus
MQNRQKAINLLGLAKRAGKLTTGTETVIGELNKGKIKAVIMASDIHDNTAEKVDRVARRNNIPIINLFTADELSKAIGKKRKVLGLTDAGFTKALVKKINEGV

SEQ ID NO: 91 - DNA, 1218 bp, Lactobacillus acidophilus
  CDS (1)...(1218)
  misc_feature (0)...(0): ORF 1259; N-utilization substance protein A
ttgcaaatattcgttttgcaattgagttttagaaaggctgatcaaaaacttatgtctaaagaaatgctagaagcgttcgctacattggaaaagaacaagggcattgaacaagatgttattgttgatgcaattaaggccgctttggtagctgcatacaagaaaaattataatcaagcacaaaacgttgaagttgattttgatgagagaaaaggcaattttaaagttatggcagttaagactgttgttgatgaagttcaagatgatcgccttgaagttagcttaaaagatgctttggcaatcaaccgtgcttatgaagtaggcgatgaaattcgttttgaagttactccaaagaattttggtcgtattgctgctcaaactgcaaagcaagtaattatgcaacgtcttcgtgaagctgaaagaaatcatattattgatgaatattctcaatacgaagatgaacttgtcactggtacagttgaaagacgcgacaatcgttttgtctatgtgaagattggtaacgttgaagcagtaatgcctcatcgtgatcaaatgccaaatgaagtttataacccacaagatcaaattcgtgtgcttgtaactcatgttggctcagattctaagggagcacaaatcactgtttcaagaactgcaccagatatggtaaagcgcttgtttgaacaagaagttcctgaaatttacgatggaactgttgaaattgtttcaatcgcgcgcgaagctggtgaccgtacaaagatggcagttaagtcaaatgaccctaatattgaccctgttggtacttgcgttggtcaaaagggtgcacgtgtacaaaatgtagttaatgaacttggtggagaaaatattgatattgtaaaatatgaagaagatccatctgactatattgctaatgcattgaatcctgctgaagtaattgctgttcaatttggcgaagacgaggaggaaaagagtgcgttagttattgtcccagattaccaattatcacttgctattggtaaaaaaggacaaaacgtacgtcttgcagctcgtttaacaggctataaaattgatattcgaccagagtctgaagtagaatttgttgatgaaaagtcaactgattctgtaagtaaagaagatacagattcttctgaagatgttgtatctactgaagaatcaactgctgatgtaactactgaagaaaaaagcgaagataacactgaagaa

SEQ ID NO: 92 - protein, 406 aa, Lactobacillus acidophilus
MQIFVLQLSFRKADQKLMSKEMLEAFATLEKNKGIEQDVIVDAIKAALVAAYKKNYNQAQNVEVDFDERKGNFKVMAVKTVVDEVQDDRLEVSLKDALAINRAYEVGDEIRFEVTPKNFGRIAAQTAKQVIMQRLREAERNHIIDEYSQYEDELVTGTVERRDNRFVYVKIGNVEAVMPHRDQMPNEVYNPQDQIRVLVTHVGSDSKGAQITVSRTAPDMVKRLFEQEVPEIYDGTVEIVSIAREAGDRTKMAVKSNDPNIDPVGTCVGQKGARVQNVVNELGGENIDIVKYEEDPSDYIANALNPAEVIAVQFGEDEEEKSALVIVPDYQLSLAIGKKGQNVRLAARLTGYKIDIRPESEVEFVDEKSTDSVSKEDTDSSEDVVSTEESTADVTTEEKSEDNTEE

SEQ ID NO: 93 - DNA, 516 bp, Lactobacillus acidophilus
  CDS (1)...(516)
  misc_feature (0)...(0): ORF 1260; Conserved hypothetical protein
gtgagcagaaatgctcactctttttattacggaggaaattttttgtctaaagttgtaaatcttgttcgtccagttgtcgaatcaattattgatgaacatggcgacatgttagtcaatatggaatatattaaagaaaaaagtcagaattatttacgtatttatgttgatcgtgaaccaaatggtattgatattgatgaaattgcagttttaagtgaactgatttctgaaaagttagatacacttgatccagatccacttcctgacccatatgttttagaattatcgtctccaggtgcagaacgtccaattaaaactaaagcagactgggaaaaagcactgaacgattatattcatgttggtctttatcaaaagatagaagataaaaagatgtacgaaggtacacttaaatcttataatgatgatgagattatattagaagtaaaagataagacaagacgaaaaacattaactgttccccgtaagttaattgcaaatattcgttttgcaattgagttt

SEQ ID NO: 94 - protein, 172 aa, Lactobacillus acidophilus
MSRNAHSFYYGGNFLSKVVNLVRPVVESIIDEHGDMLVNMEYIKEKSQNYLRIYVDREPNGIDIDEIAVLSELISEKLDTLDPDPLPDPYVLELSSPGAERPIKTKADWEKALNDYIHVGLYQKIEDKKMYEGTLKSYNDDEIILEVKDKTRRKTLTVPRKLIANIRFAIEF

SEQ ID NO: 95 - DNA, 4311 bp, Lactobacillus acidophilus
  CDS (1)...(4311)
  misc_feature (0)...(0): ORF 1261; DNA polymerase III
gtgacaaataaaaacgatcttttcttaaaattgctcaaacaggttcgctttcctgatacttttgaagataatgaccttcttcaaaaaggaaagattgaaaacgtggatgtttacgctaaagaacataggtgggatatccacgttttttttgatactccattaagatacgatacctatgttgcattaagaaaagctatagaagaaacctttgcttcatttgtaaatgttaatttttttgtaagtacagctgatggtttagatcagtatttgccagattattggaaatatgctgttcaaaattctgatcgattacagccaatggcgcgtgaatttctagctgatcaaaagcctaaaaaggtcgatggtcgatggatcattcaaattgataataatattattgatggaatgatcgaacaaagcacactagatgggttagctgaagaaatgagaaactatggtttctttaatttgaagtttattactcaattagatcaaaccagcttacaaaatagtatgcaaagcttgcaagaattacatcaagaacatgagaaaaacatgcaagagcagtatgaaaatactcctgataaacccaaaccccaaccgcaagctaagcaatatccaactaagcgtaccagttatggtaaacgcaagttagatgagaatgccccaattactcaaattaaagaagtagaagatggcactcgtaatgtagttattgaaggtaatatttttaatattgaaagtcgtgagctaaaatctggtgcagtaatctttactggtgaaatcactgattatagtgactcaattgcttttaagaaatttgtttctgataaagaacaaattgaacaaatgtcagcaattaaaccaggtacttgggctaaaatgcaaggttctgctgcagatgatcaatgggaacatgatgtagttttcactattagtagttttgaaacagtagaacatattggtcgaactgaaaaatatgatggtgaaaaaaagcgtgtagaattacaccttcatactaatatgagtcaactggatgcaactaatacgcctactgatttcattaaaactgctaaaaaatttggtcaaaaagcaattgcggtcaccgatcatggggatgttcaatctttcccagaagcttatagcacaggaaaatcaactgatatgaagatcctgtatggtgttgaagctaatatgattgatgatcatgcactattagtactgaatccagctccaatgacttatgaagatcgcgaatttgttatcttcgatgttgaaactacaggtctttcatctgtatatgacacaattattgaaattggtgctgtaaagatgaaaaacggagaagtgatcgagagattcgataagtttattaatccgcaccatccattaagtgaacaaacaataaacttaacttcaattaccgatgaaatggttagtgctgctgatgatgaagctattgttattaagcaattccaggatttttatggtgatcggcctctttgtggacataacgttcaattcgatgtggggtttgttaatgctgctttaagaagaaacggatttagtgaaattactcagccagtagttgatacacttgaagtatcacgtttacttcacccagagcaaaaccgtcatactttggattcattggctaaaaaatataatgtttctttggagcatcaccaccgtgctaatcaagatgctgaggcaacaggatacttaatgtacaagttactcgatgcctttaatgaaaaatatcatgaagataatttaaataacttgaataattatgctgcacatggtgaggtatataagagagcgcgcccttctcacatgacagttttagctaaaaatcaagcaggtttaaaaaatctatataaactagtgtctattgcaagtactaaggacttttatagaattccaagaacaccaaaatcagatttagcgcgtttacatgaagggctattttatggctctggttgctggcaaggcgacgtatttattgccatgatgcaaaaaggatatgatgaagctcgtgaaaaagctagattctatgactttttagaagtacagccacctaagaattattctcaattaattgaggatggtttaattaaggatgaagaacaattagaagagattattagtaatatttataaattagggaaagaacttaataagcctgtcgttgctacgggggatgcccactatgttgaaccacatgatgcaatttacagaactattttaatttctgctcagcgctctaatcctaatagaaataagcctcagcctgatctgcatttttattctacgcaagaaatgctggatgcttttagttttctaggtgaagatatagctaaagaaattgttattgaaaatactaataagatagcagatgaaatttctgaaattcagccaattaaggaaggattgtacccacctcatattgaacatgctgatgaagaaatgaaaaaattgacttatgataaggcatatgaactttatggcaatccattacctaaaattgttaaggatcgaattgatctagagttaaattcaattatttctaatggttatgcagttatttatttaatttcacaacgtttagtagccaagtcaaataaagatggttatttagtaggttctcgtggatctgttggttctagtttggttgctacaatgtcggggattactgaggttaatccacttgctccgcattatcggtgtcctaattgtaaatattctcaattctttgaaaatggggaatatggttctggttttgacttgccagataaagattgtccagaatgtggtacgcccttagtaaaagatggacaagatattccatttgctacattcttagggttccatggtgataaggttccagatattgatttgaacttctcgggagattaccagccagtagctcataacttcattagagttatgtttgggccagataactcatatcgtgctggtactattgctactgttgcagataagactgcttatggttatgctaagcattttgatgaagaacgtgatctaaaattaagaaatgctgaattggatcgtttagctagtggtgttcgtggtgttaaaagaaccacgggtcaacacccagcgggaattgttgttgttccagatgatatggatatttatgatttcactcctgtgtcatatccagccgatgatgtgaacgctgcttggttgattactcactatgatttccactcaattcacgataatattttgaaatttgatattctgggacacgatgatcctacgatgattcgtcacttacaagatttatccggaattgatccattgactattccacctgatgatccgggagttatgtcacttttttctggaacaaaagcattgggagttacgccggaacaaattggttctaaaactggtactttaggtgttccagagtttggtaccagattcgttagagggatgcttgaagaaactaaaccaactacattttctgaattattacagatttctgggttatctcatggtactgatgtctggttagggaacgcagaagatttgattaacaacggaacatgtgatttaaaagatgtaattggttgtcgtgacaacatcatgatggacttgattcactggggtgttaaacctgaggttgcattttcaacaatggaatctgttcgtcatggacgcgggattagcgatgaaaatatggctattcttcagaaaaataagaatattcctgattggtatattgattcttgtttgaagatcaagtacatgtttcctaaggcacacgctacagcatatattttgatggctttaagaattgcttggtttaaagtatattatcctgaaatttattacacagcttatttctcagttcgtgctgatttgtttgatttagttgcaatgagtcatggtaaaaatactgttaaagctgcaatgaaagcaatccaagataaaggaaatgacgtttcagctaaagataaaagtttattgactgtgttagaaattgctaatgaatgtcttgaacgtggtataaaaattaaaatggttgatattgatcaatctgaagcaaccgactttaaaattttggataagcatactattttagccccattcaatgcagttcctggtttaggtgataacgccgctaagcaaattgttgctgcacgtgcagaaaagaaattcttatccaaagaagatttagctaaacgtggtaaagtttctcaaacaattatgaattactttgaagacaatggcgtattagacggtatgccagatgaaaaccaattgtcactattt

SEQ ID NO: 96 - protein, 1437 aa, Lactobacillus acidophilus
MTNKNDLFLKLLKQVRFPDTFEDNDLLQKGKIENVDVYAKEHRWDIHVFFDTPLRYDTYVALRKAIEETFASFVNVNFFVSTADGLDQYLPDYWKYAVQNSDRLQPMAREFLADQKPKKVDGRWIIQIDNNIIDGMIEQSTLDGLAEEMRNYGFFNLKFITQLDQTSLQNSMQSLQELHQEHEKNMQEQYENTPDKPKPQPQAKQYPTKRTSYGKRKLDENAPITQIKEVEDGTRNVVIEGNIFNIESRELKSGAVIFTGEITDYSDSIAFKKFVSDKEQIEQMSAIKPGTWAKMQGSAADDQWEHDVVFTISSFETVEHIGRTEKYDGEKKRVELHLHTNMSQLDATNTPTDFIKTAKKFGQKAIAVTDHGDVQSFPEAYSTGKSTDMKILYGVEANMIDDHALLVLNPAPMTYEDREFVIFDVETTGLSSVYDTIIEIGAVKMKNGEVIERFDKFINPHHPLSEQTINLTSITDEMVSAADDEAIVIKQFQDFYGDRPLCGHNVQFDVGFVNAALRRNGFSEITQPVVDTLEVSRLLHPEQNRHTLDSLAKKYNVSLEHHHRANQDAEATGYLMYKLLDAFNEKYHEDNLNNLNNYAAHGEVYKRARPSHMTVLAKNQAGLKNLYKLVSIASTKDFYRIPRTPKSDLARLHEGLFYGSGCWQGDVFIAMMQKGYDEAREKARFYDFLEVQPPKNYSQLIEDGLIKDEEQLEEIISNIYKLGKELNKPVVATGDAHYVEPHDAIYRTILISAQRSNPNRNKPQPDLHFYSTQEMLDAFSFLGEDIAKEIVIENTNKIADEISEIQPIKEGLYPPHIEHADEEMKKLTYDKAYELYGNPLPKIVKDRIDLELNSIISNGYAVIYLISQRLVAKSNKDGYLVGSRGSVGSSLVATMSGITEVNPLAPHYRCPNCKYSQFFENGEYGSGFDLPDKDCPECGTPLVKDGQDIPFATFLGFHGDKVPDIDLNFSGDYQPVAHNFIRVMFGPDNSYRAGTIATVADKTAYGYAKHFDEERDLKLRNAELDRLASGVRGVKRTTGQHPAGIVVVPDDMDIYDFTPVSYPADDVNAAWLITHYDFHSIHDNILKFDILGHDDPTMIRHLQDLSGIDPLTIPPDDPGVMSLFSGTKALGVTPEQIGSKTGTLGVPEFGTRFVRGMLEETKPTTFSELLQISGLSHGTDVWLGNAEDLINNGTCDLKDVIGCRDNIMMDLIHWGVKPEVAFSTMESVRHGRGISDENMAILQKNKNIPDWYIDSCLKIKYMFPKAHATAYILMALRIAWFKVYYPEIYYTAYFSVRADLFDLVAMSHGKNTVKAAMKAIQDKGNDVSAKDKSLLTVLEIANECLERGIKIKMVDIDQSEATDFKILDKHTILAPFNAVPGLGDNAAKQIVAARAEKKFLSKEDLAKRGKVSQTIMNYFEDNGVLDGMPDENQLSLF

SEQ ID NO: 97 - DNA, 1695 bp, Lactobacillus acidophilus
  CDS (1)...(1695)
  misc_feature (0)...(0): ORF 1262; Prolyl tRNA synthetase
atgcgtcaatcaaaatttttcatgccaactttaaaggaagcaccatcagatgctgtagctgaaagtcacaagttgatgataagaggtggatacattcgtcaggttactgccggtgtatatgcatatcttccattaggctaccgcgttttgcgtaaggctgagtcaattattgaacaagaaatggataatattaatgttcctgaaatgatgatgcctcatttattgccagcaactttatggcaagaatcaggtcgttaccaaaagtatggtgcggaaatgtttaagttaaaggatcgccatggtcgtgaaagtctacttggacctactcatgaagaaacctttactgaaattattgctaaaaatcttaagagttataagcaaatgccacttgctttataccaaattcaaactaaattccgtgatgaaaaccgtcctcgttttggtcttcttcgtggacgtgaatttgtaatgcttgatggttatagttttgcagcaacacgtgaacaacttgatcaacaatttgatgatcaaaagagtgcttataagcgtatctttaaacgcgctggtgtaaccgttcacccggtaattgctgactctggtacaatgggtggtaagaattcaactgagttccaagctccagcagcaattggtgaagacactattgctactaatgaaaaaggtacttatgctgcaaatcttgaaatggctaaaagtattgatacctttaagcaagagccagaagaagcaaaagaacttactaaggttgcaacaccagcttgtgacactattaagaaattagcagaatttcttgatgttccagcaactagaattgttaagagtattctttatattgctgatgatcaaaaagttttggtattaattcgtggtgacaagcaaattaacgaagttaaattaggtcacgttttggatgctgatgatattcatgaagcaaatactgaagatttaaaggaaatcacgggtagtgaaaagggtggcgttggtcctgtaaatgctgactgggcagataagatcattgctgacgaaactgttaagggtctttacaatgttgttgtaggtgctggtgaaactgattatcaattcaagaatgcaaacttagatcgtgattttaaggtagatgagtttgctgacattagaactgctaatgagggcgaacctgacccagttgatcatttaccacttaagttcactacttcaattgaagttgggcatatctttaagttaggtacttactacactaagactatgggtgctgatttcttagatcaaaacggtaaggcacaacctgtaattatgggttcgtatggtattggtgtaactagaatgctttcagctgttgtggaacaacacttaactgatcgtggtgttgcatggccaaaggaaattgcaccatttgaaattcatatcgttcaaatgaagatgaataaagaagatcaaactgagttagctgaaaaacttgaaaagaaattcagtgaaaagtatgatgttttatatgatgatcgtaaagaacgtgctggtgttaagttcgcagatgccgacttagtaggtgcaccggtgagaattacgattggtaaaaaggctgctgatggcattgttgaagttaagagaccaacagatgaaaaagcagttgaaatgtcaattgatgaattagataagtttgtaaatcaagagttagga

SEQ ID NO: 98 - protein, 565 aa, Lactobacillus acidophilus
MRQSKFFMPTLKEAPSDAVAESHKLMIRGGYIRQVTAGVYAYLPLGYRVLRKAESIIEQEMDNINVPEMMMPHLLPATLWQESGRYQKYGAEMFKLKDRHGRESLLGPTHEETFTEIIAKNLKSYKQMPLALYQIQTKFRDENRPRFGLLRGREFVMLDGYSFAATREQLDQQFDDQKSAYKRIFKRAGVTVHPVIADSGTMGGKNSTEFQAPAAIGEDTIATNEKGTYAANLEMAKSIDTFKQEPEEAKELTKVATPACDTIKKLAEFLDVPATRIVKSILYIADDQKVLVLIRGDKQINEVKLGHVLDADDIHEANTEDLKEITGSEKGGVGPVNADWADKIIADETVKGLYNVVVGAGETDYQFKNANLDRDFKVDEFADIRTANEGEPDPVDHLPLKFTTSIEVGHIFKLGTYYTKTMGADFLDQNGKAQPVIMGSYGIGVTRMLSAVVEQHLTDRGVAWPKEIAPFEIHIVQMKMNKEDQTELAEKLEKKFSEKYDVLYDDRKERAGVKFADADLVGAPVRITIGKKAADGIVEVKRPTDEKAVEMSIDELDKFVNQELG

SEQ ID NO: 99 - DNA, 837 bp, Lactobacillus acidophilus
  CDS (1)...(837)
  misc_feature (0)...(0): ORF 1263; Eep - determinant for enhanced expression of pheromone
atgatgctcccattattgaaaaaaactggtactgaattaattatcgctccacgtgatacgcaatttaatcaggctaatgtctggcaaaaacttgcaactaattttgcaggaccttttatgaatattgtcttaggatttgtagtgttcttaatttggacttttacagttccaggtcctgcaactacaactgtaggctctgtccaaacagattcgccagcgcgtagtgctaagatcgaatctggtgatagaatagttgcaataaatgatcaaaacatcactaattttgatcaagtatcagaaaaaataaatcaaagtaagggtaagagcttacgttttaaattggaaaagaatggttctactagaactatttctgttaagccaaaagcacataaagtgcaaaatcagactgtctatcaagtcggtattgttgctaaaagtaacgaaaatgcaggcgtaaaattgaagagaggctgggacacagcagtttctactactggtttaatttttaatgccgtaggtaatttatttagtcatttcagtttaaataagttatcaggtccagtgggaatttattctcaaacttctcaagtttctcagatgggctttacttatgtattagcattcttggggatgatttcaattaatctgggaattgtaaatttaattcctattccaggattagacggtggtaagcttttattgaacttgatcgaattaattcgcggtaaggcaatctctgaagaacacgaagcgattgttgaattaattggctttggtttattattagtattaattattgcagttacaggtaacgatatttatcgctattttattaaa

SEQ ID NO: 100 - protein, 279 aa, Lactobacillus acidophilus
MMLPLLKKTGTELIIAPRDTQFNQANVWQKLATNFAGPFMNIVLGFVVFLIWTFTVPGPATTTVGSVQTDSPARSAKIESGDRIVAINDQNITNFDQVSEKINQSKGKSLRFKLEKNGSTRTISVKPKAHKVQNQTVYQVGIVAKSNENAGVKLKRGWDTAVSTTGLIFNAVGNLFSHFSLNKLSGPVGIYSQTSQVSQMGFTYVLAFLGMISINLGIVNLIPIPGLDGGKLLLNLIELIRGKAISEEHEAIVELIGFGLLLVLIIAVTGNDIYRYFIK

SEQ ID NO: 101 - DNA, 450 bp, Lactobacillus acidophilus
  CDS (1)...(450)
  misc_feature (0)...(0): ORF 1264; Eep - determinant for enhanced expression of pheromone
ttgaagggtatactaatctttttagttgtctttggcttacttgtttttgttcatgaatttggacacttcattgtagctaaaaagtcaggaattcttgtgcgagaattctcaattggtatgggcccaaaactattccaaattagacgaaatcccaccacttataccattcgttggttaccacttggtgggtatgttcgtttagcgggctctgatgatgaaagtaaattagatccgggtatgactgtagtcttacagttaaatgataaaaatgaagtgattagaattgatgcttctgaatcagatattccgatcgaggggattcccgttcaagtcactaaagctgatttagtggatgatttaataatcgaaggttatgagaatggcgatgaaaatgatccagtaacttatcatgtaaatcatgatgctcccattattgaaaaaaactggtac

SEQ ID NO: 102 - protein, 150 aa, Lactobacillus acidophilus
MKGILIFLVVFGLLVFVHEFGHFIVAKKSGILVREFSIGMGPKLFQIRRNPTTYTIRWLPLGGYVRLAGSDDESKLDPGMTVVLQLNDKNEVIRIDASESDIPIEGIPVQVTKADLVDDLIIEGYENGDENDPVTYHVNHDAPIIEKNWY

SEQ ID NO: 103 - DNA, 813 bp, Lactobacillus acidophilus
  CDS (1)...(813)
  misc_feature (0)...(0): ORF 1265; Phosphatidate cytidylyltransferase
atgaaacaacgtgtaattacggcagttattgccttaatcttatttattccaattgtgcttgcaggcggcctttggatggattggttgactgtattatttgctgcagtcggcattagtgaaatctttttgatgaaaaagcaaattttagtatcatttgatttcttactagctttgcttgcaactttaacttggacagtaccagattcattttttaaagtatttccttcaaacattactaaattaggtgtgttttatggaattatcatgttatttttaacttggacggtgctatccaaaaataaaaccacttttgatgatgtaggtgtttatattttagcagcactttatattggaattggttttcactacatggctgcaattagagcatatcctcaaaatggtttagctcttcttggttatgtatttgtggttgtatggtcaactgatattggtgcctatatgattggtcgtaagatcggtaagcataagttatggccagtaatcagtcctaataaaacttgggaaggctcaattggtgcagttatttgtgcattaatttgtagtgctatttacttagcaattttgagtagcttcaatattacttttggtgtttcagaattatcaatggttgtattggcattcttcctttcaatcgtaggacaaatgggtgatcttgttgaatcagcatacaaacgtttttatggcgttaaagattctggtaagattttgccaggacatggtggtatcctagaccgctttgatagtatgttgtttgtattacccgtagtagccgctattctaggtattgttcat

SEQ ID NO: 104 - protein, 271 aa, Lactobacillus acidophilus
MKQRVITAVIALILFIPIVLAGGLWMDWLTVLFAAVGISEIFLMKKQILVSFDFLLALLATLTWTVPDSFFKVFPSNITKLGVFYGIIMLFLTWTVLSKNKTTFDDVGVYILAALYIGIGFHYMAAIRAYPQNGLALLGYVFVVVWSTDIGAYMIGRKIGKHKLWPVISPNKTWEGSIGAVICALICSAIYLAILSSFNITFGVSELSMVVLAFFLSIVGQMGDLVESAYKRFYGVKDSGKILPGHGGILDRFDSMLFVLPVVAAILGIVH

SEQ ID NO: 105 - DNA, 657 bp, Lactobacillus acidophilus
  CDS (1)...(657)
  misc_feature (0)...(0): ORF 1282; Uracyl DNA glycosylase
atgaaatatcctaaagaattggttgaagaagttcgaaaacgttcagaaggaatgaagcttgaaggaataaactctggaagtggtcctaagcatcctctattaatgttagttggtgaagcacctgggagaaatgaaatcgtaaataacattccctttagcggagatgcaggtaaagaattgaataaatctcttgagcaaataggcttaacacgagatgaagtttatataactagtgcagttcgtagtagaccatatgcaattaaaaagacatttagtaaacgggaaaacaaagaagttactaaatatcctaatcgcaaaccaacaaaaaaagaaattttggctcatggtccttttttagattatgaaattgactatgctcaacccaaattaatcgtggcattaggcagtacagggctagaaagattactagggtcaggccataaaatttcagaagaacatggtacagtgattgagaacactccaattttaaaattaaatagtgccaaagatggttatatttggtcgaaagaaagatatactatttttcccgaatatcatccagctgccattttctataatcgaaaattaactgatataattgttaaagattgggaagtaataaaaccttatttagctaaagaaagagaaacaaatgag

SEQ ID NO: 106 - protein, 219 aa, Lactobacillus acidophilus
MKYPKELVEEVRKRSEGMKLEGINSGSGPKHPLLMLVGEAPGRNEIVNNIPFSGDAGKELNKSLEQIGLTRDEVYITSAVRSRPYAIKKTFSKRENKEVTKYPNRKPTKKEILAHGPFLDYEIDYAQPKLIVALGSTGLERLLGSGHKISEEHGTVIENTPILKLNSAKDGYIWSKERYTIFPEYHPAAIFYNRKLTDIIVKDWEVIKPYLAKERETNE

SEQ ID NO: 107 - DNA, 930 bp, Lactobacillus acidophilus
  CDS (1)...(930)
  misc_feature (0)...(0): ORF 1283; Glycosyl transferase
atgaaaaaattatcgattgtggttccttgttataatgaagaagaatcaattcctctcttttataatgcagtagaaaaagtaatgcagactattctggatttagactatgaatattggtttgtcaatgatggttcatctgataaatcgcttgaagaaatgaggcaacttcaaaaaaatgatccagaacatgtccattatgtctcgttttcacgtaattttggtaaagaagcagcactttatgcaggcttgcaggcatctataggagattatatagtagtgatggatgtagatttgcaagatccacctgaatttttgcctgaaatgtataattacattaaaaccggtaagtatgattgtatcggaacgcgtcgtgtagatagaaaaggtgaggctaaatttaaatcttttctttcagacatgttttataaattagttaataaaatttctaatactgaaattgtatcgggtgctcgtgattatcgtatgatgacgcggcaaatggttgatgcggttttaagtatgcctgagtataatcgcttttcaaaaggaattttttcttgggtagggttcaaaacaaaatatttagactatcataacgttgaaagagtagctggtgagagtgattggaacacttggaagctatttaaatatgcaatggatggaatagctgacttttcacaagctccgttaaatattgcagtttggataggaacaacttcatttattctttctattattgggttagtctttgtaattgtgcggcattttatagataccaactcaagtgtatttggttgggcgtcaatggtaagtattattttgcttcttggcgggcttcaattattatgtataggcatattagggaaatatttaggaagaatatatttacaagttaaaaatcggccgatatatataattaaggagaaaaaa

SEQ ID NO: 108 - protein, 310 aa, Lactobacillus acidophilus
MKKLSIVVPCYNEEESIPLFYNAVEKVMQTILDLDYEYWFVNDGSSDKSLEEMRQLQKNDPEHVHYVSFSRNFGKEAALYAGLQASIGDYIVVMDVDLQDPPEFLPEMYNYIKTGKYDCIGTRRVDRKGEAKFKSFLSDMFYKLVNKISNTEIVSGARDYRMMTRQMVDAVLSMPEYNRFSKGIFSWVGFKTKYLDYHNVERVAGESDWNTWKLFKYAMDGIADFSQAPLNIAVWIGTTSFILSIIGLVFVIVRHFIDTNSSVFGWASMVSIILLLGGLQLLCIGILGKYLGRIYLQVKNRPIYIIKEKK

SEQ ID NO: 109 - DNA, 1746 bp, Lactobacillus acidophilus
  CDS (1)...(1746)
ttgagcattaatggcaaaaaaataatatatcgttttattccatatttaataattttaactttcgtaactatacttattagtcctcaattgattggtcatgctacttttataactgcagatcgctttttccattttggacgtttttatgattcgcttcagcaaattaaaacaggaaattataattattttcaaacaaattatagttttgggcagtgtggaagaataattaatgcagtctatggaccatattttgcttatttgaatgggttacttctatgggcttgtggaagctggtttaaatacgaaattgttgttgactatatcttatttttagtcgctggaatgggaatgtttcgactaacccaaaaggtaaatacgccatattggataggattattgctcagtttactgtatttaagtgtggggattttaccaggctggttacgtgcaaataattttatggcttgtggaagcgcattagcaccatatgtagttatgataggaattgaaatggtccaaaataaagaaaagccggtttctactatcaaattaatgctaattatgtcgcttttagcacaaattcatttattaagtacagttattttagcttttgcgctcattccatttgcaattatcggttttaaaaatactcctaacaaaaagttgatgattagggatttagctttggctgtaggaggcactttactattaactgctaatatttggggtgcacttttagaagtctcaattcataatcaaatggctcttcctaaagcatttaatctttcatcgacggcaatgcgattaagttctcataatagtgaacactcgcatgttttaaaagttctagctattttgctcgttttgcaattaatttatgcaatttggcatgtaaaaaagaataaaatgaattttcttttaactgtttggggggctttcttcttaattatttcatccaaacttatgccatgggatagtattcaaataatattaccagttttgggcagatcatttcagtttccatatcggttaatggtagcaggatatccattactttttgcagggatgggaattacagttcaggaattgagtaatttaaatattaagcaaaaatctaatttgattgttcaagttttaatttatttaggcttaggacttactctttttaaagccggtcaatctacttttaagactaatcaaaaattcactagaatttataatgatcctaatcaagtagtggcaatgactagctattataaaatgacatctgatcctactaagttttggcaagcaacgaattctactaatttgggtaaattgtttattttaattaataaagctgaagctgattatttgccagattatggaaaacctagtgctagttttgagacgagaaaagcatatgaagaacatgttttaaaaaagaaaaatttatatattcattatgtgaaaaacggaaatctttatctaaaatggtatgctaaaaaaattaataaaaggtatttaccccttattttatacagtgaatcttcattaattttgaatggtcaagagttaaaaaagattaaggtaagtaatgtaggtacgcctttaattcaagagaagaagggctggaacattgcacggctatcatttaagtgccctgaaagttttaaattatgcattattgttagtcttgtttcttggatactaatgcttttttatgggataagaatgtggatcaaaagatatgtaaagaaggatatt

SEQ ID NO: 110 - protein, 582 aa, Lactobacillus acidophilus
MSINGKKIIYRFIPYLIILTFVTILISPQLIGHATFITADRFFHFGRFYDSLQQIKTGNYNYFQTNYSFGQCGRIINAVYGPYFAYLNGLLLWACGSWFKYEIVVDYILFLVAGMGMFRLTQKVNTPYWIGLLLSLLYLSVGILPGWLRANNFMACGSALAPYVVMIGIEMVQNKEKPVSTIKLMLIMSLLAQIHLLSTVILAFALIPFAIIGFKNTPNKKLMIRDLALAVGGTLLLTANIWGALLEVSIHNQMALPKAFNLSSTAMRLSSHNSEHSHVLKVLAILLVLQLIYAIWHVKKNKMNFLLTVWGAFFLIISSKLMPWDSIQIILPVLGRSFQFPYRLMVAGYPLLFAGMGITVQELSNLNIKQKSNLIVQVLIYLGLGLTLFKAGQSTFKTNQKFTRIYNDPNQVVAMTSYYKMTSDPTKFWQATNSTNLGKLFILINKAEADYLPDYGKPSASFETRKAYEEHVLKKKNLYIHYVKNGNLYLKWYAKKINKRYLPLILYSESSLILNGQELKKIKVSNVGTPLIQEKKGWNIARLSFKCPESFKLCIIVSLVSWILMLFYGIRMWIKRYVKKDI

SEQ ID NO: 111 - DNA, 426 bp, Lactobacillus acidophilus
  CDS (1)...(426)
  misc_feature (0)...(0): ORF 1285
atggtagaaaaaattaaagctttatttctttcagaagattttcgccaattaattggttactgtttaattggtggcttaggcttagtagtagattttggtgtttttacgctattagtacatttaaatgtaaatgtcgaattggctaattttattagttctagttgcggattaatcaataatttcctttggaactcatttgccaactttaaagtacacgataagcttctattaagattcatatcttattatttagtaggccaggtaactactatttttactacactttgtctttttatttttgtagataagttaggatataacacaattatagttaaagtggtttctacattcattgctactttgatccaatttgtgattaataaggttcttacgtttcgaaaagatacgagaattaaaaaagaagac

SEQ ID NO: 112 - protein, 142 aa, Lactobacillus acidophilus
MVEKIKALFLSEDFRQLIGYCLIGGLGLVVDFGVFTLLVHLNVNVELANFISSSCGLINNFLWNSFANFKVHDKLLLRFISYYLVGQVTTIFTTLCLFIFVDKLGYNTIIVKVVSTFIATLIQFVINKVLTFRKDTRIKKED

SEQ ID NO: 113 - DNA, 432 bp, Lactobacillus acidophilus
  CDS (1)...(432)
  misc_feature (0)...(0): ORF 1286; 50S ribosomal protein
ttgtgtcaaaacacaaaatgtataagttatgggtattccgctgacgctggtacgttgatgaatgccgaagaaggagaaaaatatattatggatccattaattcaagaattaactaaagaacaaattcgtgacgatattcctgcattccgtgcaggtgacactgttactgttcacgtacgtgttgttgaaggtactcacgaacgtatccaattgttcgaaggtgttgtaattaagaagaagggtactggcatcggtgctacttacactgttcgtaagattgcttcaggtgttggtgttgaaagaactttcccagttaacgacccacgtgttgctaaggttgaagttaagcgtcatggtcgtgtacgtcgcgctaagctttactacttacgtgaacgtcacggtaagtcagcaagaattgctgaagcacgtcgt

SEQ ID NO: 114 - protein, 144 aa, Lactobacillus acidophilus
MCQNTKCISYGYSADAGTLMNAEEGEKYIMDPLIQELTKEQIRDDIPAFRAGDTVTVHVRVVEGTHERIQLFEGVVIKKKGTGIGATYTVRKIASGVGVERTFPVNDPRVAKVEVKRHGRVRRAKLYYLRERHGKSARIAEARR

SEQ ID NO: 115 - DNA, 726 bp, Lactobacillus acidophilus
  CDS (1)...(726)
  misc_feature (0)...(0): ORF 1287; Putative tRNA methyltransferase
atgaagattaatatcctgaccctttttcctgatatgtttacgccattgcaagtttctatgctgggacgtggtcttgaagatggtaagtgggatctcaatttggttaatttccgtgatttcactacagacctgcatcaccatgttgatgatacgccatatggtggcggagcgggaatggtgcttcaaataatgccgattaagaaagcacttgattcacttccttctactggcaagattattattactgcaccacaaggtaagacatttaatgaaaaaatggcacaagaatgggctaaggaagatgaattaacttttatttgtggtcactacgaagggtttgatcaacgtgtttatgatttggctgatgaaactgtttcaattggagattatgttttaaccggtggagaattacctacaatgagtatggttgatgcaacagttagattattaccaggtattttaggtaattctgcttcatcagttgaagaaagtttctcacatggcttacttgagtatccgcaatatactcgtccagctgatttcgaaggaaaaaaaagtgccagaagttttaagccagtggtaatcatcaaaagattgctgaatggcgacactatcaggcttttaaaggcaacatatttacatagacctgatatgcttgaaaatcgcaatctttctgatgaagaaaagaaaatgctgcaagaaataaagaatgaaatgaatgaggat

SEQ ID NO: 116 - protein, 242 aa, Lactobacillus acidophilus
MKINILTLFPDMFTPLQVSMLGRGLEDGKWDLNLVNFRDFTTDLHHHVDDTPYGGGAGMVLQIMPIKKALDSLPSTGKIIITAPQGKTFNEKMAQEWAKEDELTFICGHYEGFDQRVYDLADETVSIGDYVLTGGELPTMSMVDATVRLLPGILGNSASSVEESFSHGLLEYPQYTRPADFEGKKSARSFKPVVIIKRLLNGDTIRLLKATYLHRPDMLENRNLSDEEKKMLQEIKNEMNED

SEQ ID NO: 117 - DNA, 582 bp, Lactobacillus acidophilus
  CDS (1)...(582)
  misc_feature (0)...(0): ORF 1288; 16S rRNA processing protein
ttgctattaattaaaagcttgatgccaagtgcttcaagctttttttattacttaaaaggagaaaaaggtatgcagtactttgatgttgcacgaattttgactacacatggattacatggagaagttaaagtaaatgtgattacggattttccagaagatagatttgctgaggggatgcaactagaattaaaagatgatattgatcgagttttaacaataaaaaagagtagaccatttaagcaattttggctacttcaatttgatgaaataactgatattgatgaagctgaaaaattacgtggaaaaattttagtaattagtgaaaaagatcgtggtgaattaccagatggagtttactattacaaggatatttttgattgtggtgtaatagacaatgagactggtaaaagattaggtaaaataactgatattcaatcacctggtgctaacgatatttggcttgtgcatgaagacaatggtaaagaatattggattcctaatattgctgatgttgtaaagaaaatagatattgctgataaaaaggtatatgttgaattgatggagggattgcgagatgaagat

SEQ ID NO: 118 - protein, 194 aa, Lactobacillus acidophilus
MLLIKSLMPSASSFFYYLKGEKGMQYFDVARILTTHGLHGEVKVNVITDFPEDRFAEGMQLELKDDIDRVLTIKKSRPFKQFWLLQFDEITDIDEAEKLRGKILVISEKDRGELPDGVYYYKDIFDCGVIDNETGKRLGKITDIQSPGANDIWLVHEDNGKEYWIPNIADVVKKIDIADKKVYVELMEGLRDED

SEQ ID NO: 119 - DNA, 270 bp, Lactobacillus acidophilus
  CDS (1)...(270)
  misc_feature (0)...(0): ORF 1289; 30S ribosomal protein
atgtcagttaaaattcgtatgcaccgtgctggtgccaagagaaagccgttctacagaatcgttgttgcagactcacgtatgccacgtgacggtcgtttcatcgaacaagttggttactacaacccagtttcacaaccaaaggaattgaagcttgacgaagacaagatctttgaatggttacaaaagggtgcacaaccttcagacactgttagatcacttctttcaggtgctggcttgatggctaagttgcacgatgcaaaatacaacaaa

SEQ ID NO: 120 - protein, 90 aa, Lactobacillus acidophilus
MSVKIRMHRAGAKRKPFYRIVVADSRMPRDGRFIEQVGYYNPVSQPKELKLDEDKIFEWLQKGAQPSDTVRSLLSGAGLMAKLHDAKYNK

SEQ ID NO: 121 - DNA, 1428 bp, Lactobacillus acidophilus
  CDS (1)...(1428)
  misc_feature (0)...(0): ORF 1290; Signal recognition particle protein
atggcttttgaaaatttaagtgaaagaattcaaaaagcattaaaaaatttaactggtaaaggtaaggtttcagaagaagatattaataaggctagtcgtgaaatcagattagctcttcttgaagccgatgttaactttaaagttgttaaggacttcattaaaacaattaagaaagaggcacttggtaaggaagttcaagaaagtcttaatccaggtcaacaagtaattaaaattgttaatgaagagttgactaagatgatgggggaagaagcagtccctcttaataaatccaagcatattcctactattatcatgatggtaggtttgcaaggtaccggtaagactactacagtaggtaaacttgcatatcatctacaaaagacgcagaaagctcgtcctcttttaattgctggggatatttaccgtccggctgccgttgaccaactaaaacaaatcggtgagcaattaaaagtgccagtctttagtgaaaatggagaaaaagatgttgctaaaattgttcaagatggtttagcagaggccgataagaacaaaaatgattatgtattaatcgatacagccggtcgtcttgaaattgacgagccattaatggaagagctggaacgtgtaaagaaagtagcggatcctgacaatattttacttgttgttgatgctatgacaggtcaagcagcaaccgatgtagctaaaggttttgatgagagattagatgttaccggtgttatcttgactaagcttgatggtgatactcgtggtggtgctgcactttcaattcgtgctgtaactggtaagccaatcctatttacaggacaaggtgaaaagttaagtgacttggatgttttccacccagatcgaatggcttcaagaatcttgggtatgggtgatatgctttccttaatcgaaagagcacaacaagattatgatgctaaagaagctcaaaaagttgcggaaaagatgcgtgaaaacacctttgactttaatgacttcgttgatcaattacaacaagttcaaaagatgggaccattagaccaaattatgaaaatgattccagggcttgctaataatcctcaacttaaaaacttaagtgttgatcaaaagcaaattgatcatactgaagcaattgtttattcaatgacagaagaagaacgtgagaatccagatattttaaatccaagtcgtcgaagaagaattgctgcaggttcaggtcgtccagttgttgaagtaaacagaatgatcaagcaatttaaacaaatgcgcgaaatgatgagcaaagttactaaggggaatatgaaaggcttaagtaacttgccaggaatggattcaccaatggctaaaatggctatgcgccggttaaataagaactttaagaagaataagaagaagcgattgcgtaaggttaagagatatcattca

SEQ ID NO: 122 - protein, 476 aa, Lactobacillus acidophilus
MAFENLSERIQKALKNLTGKGKVSEEDINKASREIRLALLEADVNFKVVKDFIKTIKKEALGKEVQESLNPGQQVIKIVNEELTKMMGEEAVPLNKSKHIPTIIMMVGLQGTGKTTTVGKLAYHLQKTQKARPLLIAGDIYRPAAVDQLKQIGEQLKVPVFSENGEKDVAKIVQDGLAEADKNKNDYVLIDTAGRLEIDEPLMEELERVKKVADPDNILLVVDAMTGQAATDVAKGFDERLDVTGVILTKLDGDTRGGAALSIRAVTGKPILFTGQGEKLSDLDVFHPDRMASRILGMGDMLSLIERAQQDYDAKEAQKVAEKMRENTFDFNDFVDQLQQVQKMGPLDQIMKMIPGLANNPQLKNLSVDQKQIDHTEAIVYSMTEEERENPDILNPSRRRRIAAGSGRPVVEVNRMIKQFKQMREMMSKVTKGNMKGLSNLPGMDSPMAKMAMRRLNKNFKKNKKKRLRKVKRYHS

SEQ ID NO: 123 - DNA, 348 bp, Lactobacillus acidophilus
  CDS (1)...(348)
  misc_feature (0)...(0): ORF 1291; Conserved hypothetical protein
gtgaaacttatggatgaattgacaaaaaatgaagagcttggagatttatatgcatattacggctctttgcttactaagggacaacaatcttattttgaagattattattataatgatttatctttaggagaaattgctattaatcatcatgtatcacgtcaggccgtttatgataatctaaagcgatcaagtaaaagtttacaaaactatgaagaaaaacttcatatgcgtaaagataataattatattgaaaatattttaactagtgtgctatcgtcattgaataataacgacgataaagctgctaaaaatgaaataacgaatttattaaataaattgaggggagag

SEQ ID NO: 124 - protein, 116 aa, Lactobacillus acidophilus
MKLMDELTKNEELGDLYAYYGSLLTKGQQSYFEDYYYNDLSLGEIAINHHVSRQAVYDNLKRSSKSLQNYEEKLHMRKDNNYIENILTSVLSSLNNNDDKAAKNEITNLLNKLRGE

SEQ ID NO: 125 - DNA, 1464 bp, Lactobacillus acidophilus
  CDS (1)...(1464)
  misc_feature (0)...(0): ORF 1292; Putative amino acid transporter
atgaattacatactattcatatcaaggaggagttgcgttgtgaatctttggcaaaaaatgaacaagaaagaagatccacgcgtctatgaaaataaagatggacacctggttcgctcattgaaagttaaggactttttagccttaggtgttggaacaatagtttctgcttctatctttactttacctggtgaagtagcagcattgcacaccggtccagctgtggcaatttcatttattttagcagctgtcgcagccggacttgttgcatttgcatacgcagaaatggctgctgcaatgccctttgcgggatctgcttattcatggattaatgtggttttcggtgaattctggggctgggttgccggatgggcgcttctagcagaatactttattgctctagcctttgtaggatccgggctttcggctaactttagagctttaattgctccattaggaataaaattacctgcagccttatccaatgcatttggaactaacggtggggttattgatatcatttcacttatatcaattctgttagttgctcttttaatcagtcacggtgtttcaagagcagcgcgcgttgaaaatgcattagttgtattaaaagttttagcaattttattttttatcgttgttggtttaaccgcaattaagggttctaattttgtcccatttattcctaagtatcgtccaactgctcacggaccttttggtggttggcaagggatatatgctggtgtatcaatgattttcttatcctacatcggttttgattcaattgctgctaactcagccgaagcaattaatccccaaaagactatgccacgcggtatcttaggctcacttgccattgcagttacattatttgttggcgttagtcttgtattaattggtatcatgccatatcaaaaatatgctaactcagctgagcctgttggtttagctcttcgttatgcaggacatcctattgtagctattgttgttcaaactattgctgttcttggaatgttcactgccttaatcggaatgagtatggcaggttcaagattgatttattcatttggtcgagatggtatgcttcctaaatggctaggtaaattaaatgctgatcgtcgtcctaacaatgctttatggactttaacagttattggtatcttacttggggcattcttcccattctctatgctgtctcaattagtttcagcaggtacccttatcgcatttatgttcgtatcactgggaatttataaattacgtcctcgtgaaggtaaagacattgatgatccttcatttaagatgccattttatccagtattaccagcattaggtttcttagccgcattagtcgtattcttgggattagattatcaagccaaactttatgccggtatctggtttattctaggattgcttatttacttaggatatggtgtacaccactctgttttaaacaataaaaaa

SEQ ID NO: 126 - protein, 488 aa, Lactobacillus acidophilus
MNYILFISRRSCVVNLWQKMNKKEDPRVYENKDGHLVRSLKVKDFLALGVGTIVSASIFTLPGEVAALHTGPAVAISFILAAVAAGLVAFAYAEMAAAMPFAGSAYSWINVVFGEFWGWVAGWALLAEYFIALAFVGSGLSANFRALIAPLGIKLPAALSNAFGTNGGVIDIISLISILLVALLISHGVSRAARVENALVVLKVLAILFFIVVGLTAIKGSNFVPFIPKYRPTAHGPFGGWQGIYAGVSMIFLSYIGFDSIAANSAEAINPQKTMPRGILGSLAIAVTLFVGVSLVLIGIMPYQKYANSAEPVGLALRYAGHPIVAIVVQTIAVLGMFTALIGMSMAGSRLIYSFGRDGMLPKWLGKLNADRRPNNALWTLTVIGILLGAFFPFSMLSQLVSAGTLIAFMFVSLGIYKLRPREGKDIDDPSFKMPFYPVLPALGFLAALVVFLGLDYQAKLYAGIWFILGLLIYLGYGVHHSVLNNKK

SEQ ID NO: 127 - DNA, 405 bp, Lactobacillus acidophilus
  CDS (1)...(405)
  misc_feature (0)...(0): ORF 1293; Transcriptional regulator/MarR,EmrR family
atgacaggaaatacaattggttcattttttaccaagattagtaatgaagttgaaaagcaaatggatgatgatttaaagagttttggcattgatgctaatgaattggaatttttaattgagttaaatcatcataagcatgggaaaaattttgataaacttgctaaggaacttcatgtaacagatgacaaagtcaaagaaatagctaaaaagttagttactaaggacttaattaccgtagcagatgatgtagttactgaaactgaaaaaggctcagaactatgtaaaaaggtggaaaagcatcgtttagaaactgatcatacaattacagggatgctgagcaaagaagaaatattaggtttggttaatgttttaaagaaaatgctaaaaaaagacgaaactaaagat

SEQ ID NO: 128 - protein, 135 aa, Lactobacillus acidophilus
MTGNTIGSFFTKISNEVEKQMDDDLKSFGIDANELEFLIELNHHKHGKNFDKLAKELHVTDDKVKEIAKKLVTKDLITVADDVVTETEKGSELCKKVEKHRLETDHTITGMLSKEEILGLVNVLKKMLKKDETKD

SEQ ID NO: 129 - DNA, 1461 bp, Lactobacillus acidophilus
  CDS (1)...(1461)
  misc_feature (0)...(0): ORF 1294; Putative dipeptidase
gtgttaaagttaagaggtaatagaatttataaggagaattttatgaaagaatatagtgcttgtactaccatcttagttggtaaaaatgcctcaattgatggcacaactatgattgctcgtaatgatgataccttccgcccaattactccacaaaagtttattattgagccagctcgtcatggcgaaaagaaacatattaaatcatggcttaataagtttgagatggatcttccagaagatgcacaacgagttcctgccgtaccaaatgttgattataaacatcgtggttactacgatgaaagtggtattaaccaagaaaatgttgctatgtcatgtactgaatcaacttatggtaatgaaagaactttagcatttgatccattggttaaagatggattagatgaagactgtatgcaaaccgtagttttgccatacattcattcagcacgtgatggtgttaagtatttaggtaagttaattgctaagtatggctcaccagctggtaactctgttttgttcagtgataaagatgaaatttggtacatggaaattgtaactggtcaccactgggtagcagaacgtattcctgatgattgctatgctgcaactggtaaccgtgtagctattgaacaagtcgatttcgataatcctgaatacttcatgtggagtgaaggaattcaagaatttgttgaagaacatcacttgaatccagatcatgaaggttggaatttccgtcatatctttggtacttacactgaacaagatcgccactacaatactaaccgtcaatggtatattcaaaagttgttcaacccagaaattgaacaagatccacaagatggcgatattccatttattcgtaaggcagctaagaagattaccaaggaagatattgaatttgccttaggttcacattatcaagatactccatatgatccatttggtaagggtaccgaagaagaaaagcaccgctaccgtcctattggtttgaaccgtacgcaaaatgctcatattttacaaataagaagtgatgtaccagcagaccgtgcagcaattatgtggttatgtattggtggtccaacgtttactccatttatcccattctttgctaatatgaatgaaactgatccttcatttaacaatacttcaatggattacaatatgagtgatgcatggtggtactacaagtcatttgctgcacttgttgaaagccactatccacaatttgttcaacttgatactacttatcttactgaacttaatcgttacttcagaggtcgtgttgaagaaattattaagaattcagaaggtaaatcaggcgatgaattaactgaatacttaactaaagaaaatcaaaagactgttgctcatactcgcaaggaaactgaaaagttatggggagaaatgatgattgattcaattaatatgtctaagttgacttttaatatggatgaaaatctc

SEQ ID NO: 130 - protein, 487 aa, Lactobacillus acidophilus
MLKLRGNRIYKENFMKEYSACTTILVGKNASIDGTTMIARNDDTFRPITPQKFIIEPARHGEKKHIKSWLNKFEMDLPEDAQRVPAVPNVDYKHRGYYDESGINQENVAMSCTESTYGNERTLAFDPLVKDGLDEDCMQTVVLPYIHSARDGVKYLGKLIAKYGSPAGNSVLFSDKDEIWYMEIVTGHHWVAERIPDDCYAATGNRVAIEQVDFDNPEYFMWSEGIQEFVEEHHLNPDHEGWNFRHIFGTYTEQDRHYNTNRQWYIQKLFNPEIEQDPQDGDIPFIRKAAKKITKEDIEFALGSHYQDTPYDPFGKGTEEEKHRYRPIGLNRTQNAHILQIRSDVPADRAAIMWLCIGGPTFTPFIPFFANMNETDPSFNNTSMDYNMSDAWWYYKSFAALVESHYPQFVQLDTTYLTELNRYFRGRVEEIIKNSEGKSGDELTEYLTKENQKTVAHTRKETEKLWGEMMIDSINMSKLTFNMDENL

SEQ ID NO: 131 - DNA, 1293 bp, Lactobacillus acidophilus
  CDS (1)...(1293)
  misc_feature (0)...(0): ORF 1295; FtsY - Cell division protein
ttgggtttatttgatcgaattaaaaaatctcttttcggtaaaaatgatgaagaagagaaaaaagatgaagaaaaacaaagtcaagaacaggaagatatagaagaaacaactgatatggaaaatgactcttctaatgttgaagattcagaaaaagtagataatgatactcaagattcggaaaaaatagaagaaactgaagaaaacacttctgatgaatcatcggttgaagaagaaattagtgaaaatgataaaataactgaagatgctgataattctcaagaaacagttactgaagaggttgtggatgaagtacaatctgaggaagaaccagaacaagaattagagcccgaaaaggaaaatgattctcaagaagaactttatgaaaaggggcttgaaaagaccaataaaggttttggtgcaagactgaatgcattttttgctaaatttagaacagtcgatgaagacttctttgatgatttggaagatttgttaattgaatcagatgttggttatgaaacagcagagcaattgactgaagaacttcgtgaagaagcaaaattgcaaaatgctaagtcacgtgatgaattaaaacaagttattgttgaaaaattggtcgatctttatgataagggtggcaataataaagatgaaaaactagaatataattcggatgataagccaaatgtttacttatttgttggagttaatggtgctggcaagactacaacaattggtaaattagctaaaagatttaaagatgaaggcaaatcagttattttagctgctgctgatacttttagagctggtgccgttgaacaattagttgaatggggtaagcgagtagatgtaccagttgtaacaggtaaagaaaaggctgacccagcttcagttgtgtatgatgctacagaacgggctattaaagaaaaagtagactatcttttggtagatactgctggtcgtcttcaaaataagaaaaatttaatggctgagctagaaaaaattcaaagaactatccaaaagttattaccagatcaaccaactgagactttattggtacttgatggctcaactggacaaaatgcccttttgcaagctaaagattttgataaaactactaaattgactggtttagttttaactaaattagatggatcatcaaaaggtggggtagtattagctattcgtaatgaaatgaatttaccagttaagttagttggcttgggtgaaaaaccagaagatttggcagactttgatgcggcaaattatgcaattggtcttttccatggcttagtc

SEQ ID NO: 132 - protein, 431 aa, Lactobacillus acidophilus
MGLFDRIKKSLFGKNDEEEKKDEEKQSQEQEDIEETTDMENDSSNVEDSEKVDNDTQDSEKIEETEENTSDESSVEEEISENDKITEDADNSQETVTEEVVDEVQSEEEPEQELEPEKENDSQEELYEKGLEKTNKGFGARLNAFFAKFRTVDEDFFDDLEDLLIESDVGYETAEQLTEELREEAKLQNAKSRDELKQVIVEKLVDLYDKGGNNKDEKLEYNSDDKPNVYLFVGVNGAGKTTTIGKLAKRFKDEGKSVILAAADTFRAGAVEQLVEWGKRVDVPVVTGKEKADPASVVYDATERAIKEKVDYLLVDTAGRLQNKKNLMAELEKIQRTIQKLLPDQPTETLLVLDGSTGQNALLQAKDFDKTTKLTGLVLTKLDGSSKGGVVLAIRNEMNLPVKLVGLGEKPEDLADFDAANYAIGLFHGLV

SEQ ID NO: 133 - DNA, 3567 bp, Lactobacillus acidophilus
  CDS (1)...(3567)
  misc_feature (0)...(0): ORF 1296; Chromosome segregation SMC protein
gtgccattaacagaattagtgctagatggatttaaatcattcgctgataaaacagttattcattttaataaaggaataactggtattgtaggaccaaacggaagtggtaaaagtaacattacagaagctattcgctgggtaatgggtgaatcaagtgctaaatcacttcgtggaactaacatgaaagacgttatttttgccggaagtcaatatagaaaaccaatgaacaaggcagaagtaacccttatctttgataataaaaatcgtgagcttgcttttgaaaccgatcaagtttctgtaactagaagaattttacgttcgggagatagtgaatttttaataaataatcagcaagtacgtatgcgagatgttcgtactcttttcctagattcaggaatttcgccaaatagcttggcaattatttcacaaggacgggtcgatcaaatattaaattcacgtccggaacaaagaaggatcatctttgaagaagctgcgggtgttttacattttaaacaacaaaaagaagaagcgcagaatcagcttaaaaagacccaagataatttaattagaattaatgacttggttaaagaacttgaatcgcgattagaaccacttaatgaacaaagttcgttagcaaaagaatataaatttcaaaagtctggtttagataagaaacttaaaagtttattggcatttgaaattgagaatattaatcaacaaagagaagatattcaaaagtctgctgataaaaataagattctcttggctaaactagatgatgaggttaaagattctcaagctgcagtcactcaaaaaagagccgaatataaaaaattacgtgatgagagagatcatacacaaaataaattgttgaaattgagtaaggacctctcagaattgaacgctagtttgcaaatggcggagcaatcacgtcagtttgatgatgctactaaggaagaatataaaaatcaagttaagcagttaaagcaaaatttagttcaactaaaagccgatttagatgaattgaaaaaagaaaagaaaaagcttcaagatgaacaagatgttctaaaaattgaacgtggacaacttactggtgaactgaatgaggatcctgaagaattaaataaaaagttggatgatattcgaaacaactacatgcaactacttcaagatcaagctacaacaaataaccaaattgttaatttaaattcggatctaagaagaagtcaggcagatacaacttatcaaactggtgatgtttctaagcaattgactgacgcacaaaagcagttagaacaacttcggatagaaggtaaaaaattaactgacaagcgtcaaaaagaacagaacgctatagttagaataaataaacaaaataatcagctaaatacagaattgactaatcttcgtcaagtagttaatgcagaacgtaatgaacttgaaaaggttgaagctcgtcatgaagctttagtaaatatccaaaaaagacatgaaggctattactacggcgttcgtaatgtgttaaatcatctgaatgactttgcaggtgtaattggtgcagtgggtgaattaattacatttccggctgaacttgaagctgcaatgactactgcattaggtggtggggttcaagacttgatcactgaaagtagaattagtgctagaaatgcaattaataaactgaagcaaaatcatggtggtcgtgctacatttttaccattagatggtttgcggcaatacggaattcctcaatcaactgttactactttaaagtcttatgatggttttagaggaatagccagtgatttggtggagagtaaaactgaccaagatattactgcggcaataaattatttattgggaagcgttgttattgtagatacaatagatactgcaatgtcagttgctcaacgagtaaatcgttatagaatagttacgcttgatggggatgttatttcacccggtggttcaatgaccggtggacaaagaaatcagcgtagtaattcaccattgcagactgcgactgaaatcaatcagcttgaaaaacaaattaaaactttaaagcaaaatcttaatgaagatcaagataaacttgaaaatctagttgatcaaagtaataaagtaaatgctgaattacaagaccttcaagatgctttacgtgagaccagtcaagcaattaatgaggcagcaatttctttccaaggacaagaaaaagaagttaagcgactgctggatgctaacactttgtataaatcacgaattaaagatcgaaatgatcgaattgaattattaaagaagcaaatcaaggaagctaatgataaacaaatgcttttgactaagcaaggtgaagagcaaaaagcaaaaatgaatgatttgcaggataagattaagaactttaataatttaagccagcgtattcaagatgaactgtctaaattagatcctaagattgcggtttatactaataaacttgaaaatttatctagtcaagaaaatgaaaaaaatcatcaaattgataatagtgaaaagcagattgaagatttaacagccaagttgactattttggcgcaaaacgatgaaaattcaatgaatcaaactgctaacttagaaaaacagaaatccacgattgaacaaaaaaataatgaattgcaagctagacttaacgatctaagttcgcaattaggccaatttgacgcacaaattaatcaattagaccaagtagccagtcgaaattatgatttacgtaaagatgctgctattgagcaagaagactattcagttaaaatagctaaatttaatagttcaattaatcaaagacttgaaactttacgtgatgattattctttaacttttgaagcagctattgctcaagctgaaggtgaaaataatgaagagactcgtaatgagttagctaaaagcgtaaaattacatcggatgtcaatcgaagatataggtcccgtgaatttagattcgattcaagaatatgaagatgtaaaacagcgatatgactttttgaatggtcaacaaaatgatttgcttaaggcacgtgatgatcttgaaaagtcaatgactgaacttgacgatgaagttaaaacacgttttaagcatacttttgataccattgctgaaagttttcaaaagatttttccagtggtattcggtggtggtaaggctaaactggaattaactgaaccagataatttacttgaaacaggaattgaaattattgctcagccacctggtaagaagttacaacgattaagtttgctttctggtggtgaacgtgcattaactgcaattactttgttatttgcgatgcttcaagtaaatcctgtaccattctgtgtgctagatgaggtagaagctgcacttgatgatgccaatgttgcacgttttgcggaatttttgcttaaatatgatatgaagacaaagtttattgtcataacacatagaagaggaactatgcgacaagctgatcaactatatggtgtggtcatgcaagaatctggtgtttctcaagtagtgtcagtatccttaaaagaaatgaaagataaacatgaggtgaac

SEQ ID NO: 134 - protein, 1189 aa, Lactobacillus acidophilus
MPLTELVLDGFKSFADKTVIHFNKGITGIVGPNGSGKSNITEAIRWVMGESSAKSLRGTNMKDVIFAGSQYRKPMNKAEVTLIFDNKNRELAFETDQVSVTRRILRSGDSEFLINNQQVRMRDVRTLFLDSGISPNSLAIISQGRVDQILNSRPEQRRIIFEEAAGVLHFKQQKEEAQNQLKKTQDNLIRINDLVKELESRLEPLNEQSSLAKEYKFQKSGLDKKLKSLLAFEIENINQQREDIQKSADKNKILLAKLDDEVKDSQAAVTQKRAEYKKLRDERDHTQNKLLKLSKDLSELNASLQMAEQSRQFDDATKEEYKNQVKQLKQNLVQLKADLDELKKEKKKLQDEQDVLKIERGQLTGELNEDPEELNKKLDDIRNNYMQLLQDQATTNNQIVNLNSDLRRSQADTTYQTGDVSKQLTDAQKQLEQLRIEGKKLTDKRQKEQNAIVRINKQNNQLNTELTNLRQVVNAERNELEKVEARHEALVNIQKRHEGYYYGVRNVLNHLNDFAGVIGAVGELITFPAELEAAMTTALGGGVQDLITESRISARNAINKLKQNHGGRATFLPLDGLRQYGIPQSTVTTLKSYDGFRGIASDLVESKTDQDITAAINYLLGSVVIVDTIDTAMSVAQRVNRYRIVTLDGDVISPGGSMTGGQRNQRSNSPLQTATEINQLEKQIKTLKQNLNEDQDKLENLVDQSNKVNAELQDLQDALRETSQAINEAAISFQGQEKEVKRLLDANTLYKSRIKDRNDRIELLKKQIKEANDKQMLLTKQGEEQKAKMNDLQDKIKNFNNLSQRIQDELSKLDPKIAVYTNKLENLSSQENEKNHQIDNSEKQIEDLTAKLTILAQNDENSMNQTANLEKQKSTIEQKNNELQARLNDLSSQLGQFDAQINQLDQVASRNYDLRKDAAIEQEDYSVKIAKFNSSINQRLETLRDDYSLTFEAAIAQAEGENNEETRNELAKSVKLHRMSIEDIGPVNLDSIQEYEDVKQRYDFLNGQQNDLLKARDDLEKSMTELDDEVKTRFKHTFDTIAESFQKIFPVVFGGGKAKLELTEPDNLLETGIEIIAQPPGKKLQRLSLLSGGERALTAITLLFAMLQVNPVPFCVLDEVEAALDDANVARFAEFLLKYDMKTKFIVITHRRGTMRQADQLYGVVMQESGVSQVVSVSLKEMKDKHEVN

SEQ ID NO: 135 - DNA, 684 bp, Lactobacillus acidophilus
  CDS (1)...(684)
  misc_feature (0)...(0): ORF 1297; Ribonuclease III
atggtaagtacaaaatttttaaataaattaaaaaatgaatataatattgaattcaataatgaaaaattattagaagaagcatttacacactcttcctattctaatgaacatcctgatgatgggattcgtgattatgaaaaattagagttcttaggtgatgctgttttagaattagcagtttccaattacttgtatcgtcattatcctaagctaaatgaaggtgaattaaccagattaagatctaatatcgttagaactgaaggattttctgaatttgctatagaatgcggctttcaaaaggaaattcatttaggaaatggtgaagaaaaagcaggtgccaggaatcgtaaaactttgctagaagatgtctttgaagcttttaatggtgcattattcttggatcaaggaatgccagcagttgaacgctttttgcatttaactgtctatcctttaattgctaaaggtgaatttgatgattcacgtgattataagactgatttacaagaattgttacaacaaaacggtcctgtaaacattgaatattctgtcattagtgaatcgcaattaccgtcacattttgtagttgaattaaaaattaatgatcaagttcaaacacaaggtgaaggacataacaaaaaggccgctgaacaacaagcagcaaaggctgctttacagaagtttgaa

SEQ ID NO: 136 - protein, 228 aa, Lactobacillus acidophilus
MVSTKFLNKLKNEYNIEFNNEKLLEEAFTHSSYSNEHPDDGIRDYEKLEFLGDAVLELAVSNYLYRHYPKLNEGELTRLRSNIVRTEGFSEFAIECGFQKEIHLGNGEEKAGARNRKTLLEDVFEAFNGALFLDQGMPAVERFLHLTVYPLIAKGEFDDSRDYKTDLQELLQQNGPVNIEYSVISESQLPSHFVVELKINDQVQTQGEGHNKKAAEQQAAKAALQKFE

SEQ ID NO: 137 - DNA, 360 bp, Lactobacillus acidophilus
  CDS (1)...(360)
  misc_feature (0)...(0): ORF 1311; Putative alkaline shock protein
atggctgttaagatcaagacaaaagatggtttgattgatatttcaaacggtgtaatcgcaactgttgttggtggtgcagctacgtctaactatggcgttgtaggaatggcttctaaaaatgctattcgtgatggttttgacgggattcttaatcgtgccaattataagcgcggtgttgttgtcaagtcagaagacaatgaaattactgttgacgtgtacattattgtaggctatggacttaagatttctgaagtaagtaagaacgtacaggacagcgtaaaatttaacctttctaatcaattgggaattaatactaaagccgttaatgtaatcgttcaaagtgttaaggtacttgacgaa

SEQ ID NO: 138 - protein, 120 aa, Lactobacillus acidophilus
MAVKIKTKDGLIDISNGVIATVVGGAATSNYGVVGMASKNAIRDGFDGILNRANYKRGVVVKSEDNEITVDVYIIVGYGLKISEVSKNVQDSVKFNLSNQLGINTKAVNVIVQSVKVLDE

SEQ ID NO: 139 - DNA, 435 bp, Lactobacillus acidophilus
  CDS (1)...(435)
  misc_feature (0)...(0): ORF 1374; Putative heavy metal stress response protein
atggttttagatgaaagtaagaaaaaacaggcactgaagaagttaacccaagaagaatacgatgtaacccagaacgctgccacggaatatccatttactggcaagtacgataatttttatgaaaaaggcatctacgttgatgtggtgtctggtgagccgttgttttctagccaagataagtatgatgcgggatgcggctggcctagttttaccaagccaattgaaaagctgcagtatcaccgcgaccaatcgcatggcatggagcgtaccgaagtggtaagtccagaagcgcagtcgcatttagggcacgtttttaccgatggacctgttgatcgtggcggcttgcgttactgcattaattctgctgcattgaagtttattccatatgatcagctgaatgaagctggttatggtgagtataagaagttgtttaag

SEQ ID NO: 140 - protein, 145 aa, Lactobacillus acidophilus
MVLDESKKKQALKKLTQEEYDVTQNAATEYPFTGKYDNFYEKGIYVDVVSGEPLFSSQDKYDAGCGWPSFTKPIEKLQYHRDQSHGMERTEVVSPEAQSHLGHVFTDGPVDRGGLRYCINSAALKFIPYDQLNEAGYGEYKKLFK

SEQ ID NO: 141 - DNA, 1362 bp, Lactobacillus acidophilus
  CDS (1)...(1362)
  misc_feature (0)...(0): ORF 1401; NADH peroxidase/EC 1.11.1.1
ttggataagagaaaagtaattattgttggtgcttcacatggtggtcatgaatcagcaattgagttattagacaagtacgatgacgttgacgtaactatttacgaagccggtgacttcatttcattcatgtcatgcgggatgcaattattccttgaaaataaagttactgcagaagatgatgtaagaaactttgcacctgaagatattgagaaaaaaggcggtcatgtttatgccaatcatgaagtgactgctgttcatcccgacaagaagacagttactgtaaaagacttaactaatgattctgaagaagaagttagttatgataaattaattttatcttctggtgtaacgccaaaagttttgcctgttccaggtagtgatttaaagaatatctacttaatgcgtggacgtgactgggcttctaagttaaaagcggcaaccactgatccagcaattaagaacgtagctatcattggtgcaggttacattggtactgaagctagcgaagtatttgccaaagcaggcaagcatgtaaccttgatggatatgattgatcgtcctttaggaacttaccttaatcctgaattattggatatcttagaaccaacatttaaggatcatatggatcttaaaatgggcgttaagattgagggatttaatggcactgataaagttgaaagtgtcgagacagacaacggtgatgtatctgctgacttagttgtggtttctgctggtgtaagtcctaacactgattggttaaagggcactgttgatcttgatcaaagaggctggattaagactgatccatacttgagaactaatgttaaagatgtttatgcaattggagatgctattttgccatattcaattcctgcaggtaaaccaatgccaattgcattagcaacaactgctcgtcgtgaagcacaatatttagtcgatcacttatttgaagctaaacctgatcaagtattcaaaggtgtaattggtgcttctgcattaagcgtatttgattatcattttgctacagcaggtttgaatcaattctcagctgaaaagaatgatattccatatggaactagtttttatgaagattcaatgcgtccagcttatattccagaaaaggataatcctaaggtttatgtaagtttaactttcaatccatataaccatcaaattttgggtggtgctgttctttctaaatatgacgttactgctcaaggcaatgttttggctttggcaatcagtcataaaatgactcttgaagatttggctgagcaagatttcttcttccaacccggatttgaccgccaatggagcttactcaacttagccgcacaacatgccttaggtttagctagattt

SEQ ID NO: 142 - protein, 454 aa, Lactobacillus acidophilus
MDKRKVIIVGASHGGHESAIELLDKYDDVDVTIYEAGDFISFMSCGMQLFLENKVTAEDDVRNFAPEDIEKKGGHVYANHEVTAVHPDKKTVTVKDLTNDSEEEVSYDKLILSSGVTPKVLPVPGSDLKNIYLMRGRDWASKLKAATTDPAIKNVAIIGAGYIGTEASEVFAKAGKHVTLMDMIDRPLGTYLNPELLDILEPTFKDHMDLKMGVKIEGFNGTDKVESVETDNGDVSADLVVVSAGVSPNTDWLKGTVDLDQRGWIKTDPYLRTNVKDVYAIGDAILPYSIPAGKPMPIALATTARREAQYLVDHLFEAKPDQVFKGVIGASALSVFDYHFATAGLNQFSAEKNDIPYGTSFYEDSMRPAYIPEKDNPKVYVSLTFNPYNHQILGGAVLSKYDVTAQGNVLALAISHKMTLEDLAEQDFFFQPGFDRQWSLLNLAAQHALGLARF

SEQ ID NO: 143 - DNA, 324 bp, Lactobacillus acidophilus
  CDS (1)...(324)
  misc_feature (0)...(0): ORF 1513; Low temperature requirement protein
ttgggtacgtcaaaagatgagaaaaatgataagcaagtatttgttctaatactaacaattgagttggtattagctctaattgggttaattattggttatccaaatggtatatacggcgtaattgctggatatatttttggtttcttattgccaatatttttatataaaaaatttaatgctaaaaaagttaattttccacatttagttgaacgagttagcttgattataattattgcatttggggaagctatcgttaatttagctaactattttaataataagacacctttatttatgctatattattgtttgcttcattttgta

SEQ ID NO: 144 - protein, 108 aa, Lactobacillus acidophilus
MGTSKDEKNDKQVFVLILTIELVLALIGLIIGYPNGIYGVIAGYIFGFLLPIFLYKKFNAKKVNFPHLVERVSLIIIIAFGEAIVNLANYFNNKTPLFMLYYCLLHFV

SEQ ID NO: 145 - DNA, 1575 bp, Lactobacillus acidophilus
  CDS (1)...(1575)
  misc_feature (0)...(0): ORF 1524; LisK - Putative histidine kinase/may be involved in stress response
atgaagatgatgatcaagaataataaagaagcgcaggaagagaccaagcattcatcgctaatcattcgatgggtaagtatcgttgcattgacgattacggtctcttttgtcatattttcagttgtcgtttatcaaattgttagtcaacagtcacttaatcaacaagaagaaacttcggccaatgtggcagtaacattggatagaactttgagttcgattccaaatgaattagaaatttctaatgtgattccgtcgctttctccgtctactagacgtgtattaaaaggtggtccagctattagtagtaaagatgctaataataatgcttttagtgacaatttgatttcatcaatttctaatccagatattagtgttgctgtttataataagcataatgaagttgtttttgctaacggtgatacaacgcctaaatttaagccttttaaaggtgattcaaatgtggtgaagatcaaacaaaatcggcgtttgctattaataacttatcaaaaagtttattcatcagttaataataaattaacgggttatattgtcgtctcgaatagtatgagatattacaataatttgatgaacaacttgctgcgcttaatgctagtactttctctgattgctattgtggcatttataggtatttcttatatattggttgttagtgttgttaaaccgattaagaatatgtctaaagtggctaaggaagttaatgctgatcctaatagtgtggcaagaattaaagagcttaaccgggatgatgaattagaagaattggcaacgtcaattaataaaatgcttgatcgaatgcaaagttatattgagcaacaaaagcaatttgttggggatgtatctcatgaattgagaactccagtggccgtaattgaggggcatttgaatatgctagagcgctggggtaaagatgatccacaaattttggatgaatcaattaaggcgtctcttcaagaagctgatcgaatgaaacatttgattcaggaaatgcttgatttaactagagctgaacaaattgatgttcaatatccttatgaagtaacaaatgttaacgaaacagtaaaacgagttgtttctgatttggcaatggttcattcagactttaagattcaacttgatgaagatgatttaccaccagatacagaaattcaaatttatcatggtcacttggagcagctgttagtaattttaatagataatggtattaagtattctactgatataaaacaaattaatgtttcagctggtgtgactaaaaaagaagttaatatcattgttcaggacttcggtgaaggtatttctcaagaagatcaagagaagatctttaatcgtttctaccgtgttgataaagcaagaactcgtgaaaaaggtggtaacggtttaggattatcaatagctcaaaagttagttgatagctatgatggtgaaatcagtgttgagtccgttgaaggacaaggtagtcagtttaagctacgcttcccacggttaaccaagaaacaggcagctaaacttagaaaattaagtgaaaatgctaaaaagccaaaaagtaatttagaa

SEQ ID NO: 146 - protein, 525 aa, Lactobacillus acidophilus
MKMMIKNNKEAQEETKHSSLIIRWVSIVALTITVSFVIFSVVVYQIVSQQSLNQQEETSANVAVTLDRTLSSIPNELEISNVIPSLSPSTRRVLKGGPAISSKDANNNAFSDNLISSISNPDISVAVYNKHNEVVFANGDTTPKFKPFKGDSNVVKIKQNRRLLLITYQKVYSSVNNKLTGYIVVSNSMRYYNNLMNNLLRLMLVLSLIAIVAFIGISYILVVSVVKPIKNMSKVAKEVNADPNSVARIKELNRDDELEELATSINKMLDRMQSYIEQQKQFVGDVSHELRTPVAVIEGHLNMLERWGKDDPQILDESIKASLQEADRMKHLIQEMLDLTRAEQIDVQYPYEVTNVNETVKRVVSDLAMVHSDFKIQLDEDDLPPDTEIQIYHGHLEQLLVILIDNGIKYSTDIKQINVSAGVTKKEVNIIVQDFGEGISQEDQEKIFNRFYRVDKARTREKGGNGLGLSIAQKLVDSYDGEISVESVEGQGSQFKLRFPRLTKKQAAKLRKLSENAKKPKSNLE

SEQ ID NO: 147 - DNA, 714 bp, Lactobacillus acidophilus
  CDS (1)...(714)
  misc_feature (0)...(0): ORF 1525; LisR - Putative response regulator/may be involved in stress
atggcaaaaattctaattattgaagatgaaaagaatttggctcgatttgttgagctagaattacaacacgaaaattatgagactgtagtagaaaataatggtcgtaaagggttagatgacgctcttgcccaagattttgatgcaatattacttgacttgatgttgccagatttgaatggtctggaaattgctcgtcgagttcgtcaagtaaagactacaccaattattatgatgactgcgcgtgattctgtaattgatcgtgtatctggcttagaccatggtgcagatgattacattgttaagccttttgctattgaagaacttcttgcacgtttacgtgccgtcttacgccgagtaaagattgaaaaagatgcttctaaagttacagttgcaaaacaaaagatagttaagtttaaagatttaactattgaaactgctaacagaattgttcaccgcggagatggtaaagcaattgacttgactaaacgtgaatataacttgttaatgaccttaattgaaaacaagaacaacgtagtcagtcgtgatcaattgctgaacaaaatttggggtccagaatcaaatattgaaactaatgttgttgaagtttatgttcgttacttacgtaataagatcgatgctccaggtcaaccatcttacattaagacggttcgtggtaccggttatatggtaagagatgaagatgatgatcaagaa

SEQ ID NO: 148 - protein, 238 aa, Lactobacillus acidophilus
MAKILIIEDEKNLARFVELELQHENYETVVENNGRKGLDDALAQDFDAILLDLMLPDLNGLEIARRVRQVKTTPIIMMTARDSVIDRVSGLDHGADDYIVKPFAIEELLARLRAVLRRVKIEKDASKVTVAKQKIVKFKDLTIETANRIVHRGDGKAIDLTKREYNLLMTLIENKNNVVSRDQLLNKIWGPESNIETNVVEVYVRYLRNKIDAPGQPSYIKTVRGTGYMVRDEDDDQE

SEQ ID NO: 149 - DNA, 2091 bp, Lactobacillus acidophilus
  CDS (1)...(2091)
  misc_feature (0)...(0): ORF 1578; Serine protease
gtgaaaactatgaaatttaataaaaaagttgtgctaatttcagccgttgctttaatgatggtgtcaccagttttgtcaatgggacaaaacttaaccaccactgttaaagccgctgatgatcaaactgaaaataatcgattatttatcggaagtgtaaagtcttatatctacaacaataagggtaagcgtactacatataagggaaaatcttctcttaagtatggttctcgcgtagattatttaggtaagttttctgattataacggtaaaaacaaatactacttcatggatactaagggctacaagaagtttgcttcttacaagattattaaaggtaaggcatacttcccaattggtaagaatgcctatgtccgtgtagttaatgtcgctcagattaacgatcgtcctctttatgcaaaatcactaagtgtcgtagttagtcctaagtatgttcaaaagcaaggtcaatatgctttcgatgcagataacaatataattaagggtgtttattttaaaccgggtaaaaaattaactattgatgcacaagaatatgttactaatggtaaccacactgataccatttatcgtgtaaaaggtactaagcaatttatttatgctaatagattaaagactgcagtaaggcaacaattagaaattttatctacccaaactcacgtcattatgaataaagatactcacatgtatcttgcaaacggtgagttaaagactaagaagcctaatacaaacgatagagtaagctatcgcaaaggccaaagaactgtggttgatcaattagtttatctttgggttcctagcgaaaacaaggctgaattattctatcgagttgaaagtggttggacgcctgctggttcagaaggatatgaaccaactactagcttgggttatgttaaggtaagcgatgttgactatgattttggcccacaaatggttgatccggataacaccgctgcagaagctgaagcaggtaaggctgtcgcaactagttcagataaggctgaacttaatagtttgattaatgaaaatcttgaagacaataatttatacaaattcagttcattaagtcaacaatggaattatgctggtgctcttcaaaatgctaaggaaattaatgattcaaagactgcaaccattaatgaagttaaccaagcagtatgggaacttaaatttactaagaatgaattaagtggtgaaaaggttaagatcgacaacttaggttggatcgataattcaactgccaataagatcgttcatacagctggtagttcttaccgtagcaatcaaaatgttagatatgcgatcgacatggtaaatcacaatactgtacttcgcttaagagaatttgcagtgcaaagtaatggctcagacactaatcatcttcttgcaactagagaacttaacatcaatgactacgttactgtaactgatccaaatccaactgaaaaagcaggctatcaaagttcactttctgaaaagaacttgacaagtaactcaactttgaagaagtatgctgatttgatcgactacaatgaattgactactaacttggttgccaaaactaatactccaatttacactaacagctataagaataactacgctaatgtaagtaaagggaatgtaaatttaaccagaactagtcaaatcatcaagaagggtaacaacattggttacaaggttggccctatcgtaagagttaagggtcaatattacgcaatggttcgtagtaagaaacgttatttctacgtaagagctgatgcaattgcccgtgataactttactaaagacgcagcttacaagaagtacagtaagatgattgacgatgctgtaacttcagaaaatagtactgttttggttactcctactcaaaacacagtaacttatgaaagaaatagttacggtgagcttggttcaagccgtccttataagaaaggcactatggcttactacatcgctgaaccacatgtaatgaaatacaatggtgaatggtacttcattagtggttatccaacttacagtggtacaacttacattgctaagactgttaagctttctaaaaatactattatgaaa

SEQ ID NO: 150 - protein, 697 aa, Lactobacillus acidophilus
MKTMKFNKKVVLISAVALMMVSPVLSMGQNLTTTVKAADDQTENNRLFIGSVKSYIYNNKGKRTTYKGKSSLKYGSRVDYLGKFSDYNGKNKYYFMDTKGYKKFASYKIIKGKAYFPIGKNAYVRVVNVAQINDRPLYAKSLSVVVSPKYVQKQGQYAFDADNNIIKGVYFKPGKKLTIDAQEYVTNGNHTDTIYRVKGTKQFIYANRLKTAVRQQLEILSTQTHVIMNKDTHMYLANGELKTKKPNTNDRVSYRKGQRTVVDQLVYLWVPSENKAELFYRVESGWTPAGSEGYEPTTSLGYVKVSDVDYDFGPQMVDPDNTAAEAEAGKAVATSSDKAELNSLINENLEDNNLYKFSSLSQQWNYAGALQNAKEINDSKTATINEVNQAVWELKFTKNELSGEKVKIDNLGWIDNSTANKIVHTAGSSYRSNQNVRYAIDMVNHNTVLRLREFAVQSNGSDTNHLLATRELNINDYVTVTDPNPTEKAGYQSSLSEKNLTSNSTLKKYADLIDYNELTTNLVAKTNTPIYTNSYKNNYANVSKGNVNLTRTSQIIKKGNNIGYKVGPIVRVKGQYYAMVRSKKRYFYVRADAIARDNFTKDAAYKKYSKMIDDAVTSENSTVLVTPTQNTVTYERNSYGELGSSRPYKKGTMAYYIAEPHVMKYNGEWYFISGYPTYSGTTYIAKTVKLSKNTIMK

SEQ ID NO: 151 - DNA, 1314 bp, Lactobacillus acidophilus
  CDS (1)...(1314)
  misc_feature (0)...(0): ORF 1793
atgaataagaaaaatgtatcaatgctaatgttaagtccagcaatcttattaatgatgaatagtactattgtgcatgcggataaaggtagtacttctcatgagattagtagtaaagtagtatctaaaacaaaaaatgatgataaaaatgttcctgaatccgagcaagaaactagtagtaataacgaaattgatcaatctcaagataagcaggaaaaagaagaacaagcaattcctgaagatcaaaatgatcaatctcagaatacaaataatcaagatcctaatgacgcaagtgaagaagatgatgaagatgaagtatctgttgaagattatgaaaacaatgtaaaagattttcatagagtgaaaatgcaagaggtgaaagatcttctagcagagaaaaataatcaagaacatcttatgtacattggtcgcccaacatgttattactgccgacaattttcacctgatttaaaagatttcaatgaaatcgttaaaggtaagctgctttatttcaatattgatgatgaagaaggagcacatgattatgcttttaaggttattggtattccaggaacacctacaacgatgagatttatgaatggaaaattgataagtgcttggataggtggagaaaaaacaggacaagagctacatgattttttgtattctgacacagctaataaattagtagaacaggttgtaattaaaaatcaatcgaatgatacggctactcaagcagataatgatgtcgttgcatctgagagcgataaaacacctgaagtgactgtagaggaaaataatcaagcgcagtctaataatgatgtcgctattactaacttcgctgagaatagtgtatttgaaaatgctaaaaatgttgctagttctactgcggatttaactcaagtagcgacgggcgatcaagatgatgtagctcctaaagctgaaactaaaaataaaactgtgaagaaaccaataaaacataaaattgtagccaataaggttaagaaacaagctaaattgcataagacgaatattattatacctatgtccgctaaaaaacgtgaagatgtaaaagaaaataatcaatatgatacggtaaaagtacacggtacatctcctaatgcaattaaggacaaacaagctagaattactatgttgaaggaacttgagaatgatacttcagatactatttctactgtgtctttgccgtctactggtgagaagaaaaatatctggattcaattaatgggaatgattagtgttctagttagtgtagttttaggtatttcgttaagaaagaaaactaaggaggaaaag

SEQ ID NO: 152 - protein, 438 aa, Lactobacillus acidophilus
MNKKNVSMLMLSPAILLMMNSTIVHADKGSTSHEISSKVVSKTKNDDKNVPESEQETSSNNEIDQSQDKQEKEEQAIPEDQNDQSQNTNNQDPNDASEEDDEDEVSVEDYENNVKDFHRVKMQEVKDLLAEKNNQEHLMYIGRPTCYYCRQFSPDLKDFNEIVKGKLLYFNIDDEEGAHDYAFKVIGIPGTPTTMRFMNGKLISAWIGGEKTGQELHDFLYSDTANKLVEQVVIKNQSNDTATQADNDVVASESDKTPEVTVEENNQAQSNNDVAITNFAENSVFENAKNVASSTADLTQVATGDQDDVAPKAETKNKTVKKPIKHKIVANKVKKQAKLHKTNIIIPMSAKKREDVKENNQYDTVKVHGTSPNAIKDKQARITMLKELENDTSDTISTVSLPSTGEKKNIWIQLMGMISVLVSVVLGISLRKKTKEEK

SEQ ID NO: 153 - DNA, 963 bp, Lactobacillus acidophilus
  CDS (1)...(963)
  misc_feature (0)...(0): ORF 1898; Thioredoxin reductase/EC 1.6.4.5
ttgaaggttaatgaaaatataaggggaatagatatgaaaaaatatgatgtagcaattattggagctgggcctggtggtatggcggctgcgttatatgcagcaagagctaatttaacggtagcaatgattgatcgaggcgtttatggcggacaaatgaacaacactgctgaggtagaaaattatccaggttttccatcgattttaggacctgagcttggagaaaagatgtatcaaaacactgttaagcaaggtgttaactttgtttatggggatgttcaagggatagaagttaaagacgacaaaagaatcgttaaattaggcagtgaagacagtgacattgaaacgaaagctgtaattattggtacaggttcgtctaatcgaaaattaggagttcccggtgaagatgaatattcgggcaaaggtgtttcctactgcgcagtttgtgatggtgctttctttaagaatgaaaatgtcgtagttgtaggtggtggtgactcagctgtttctgagggactttatttagctaacgttactgataatgtaaatgtcattcatcgacgtgatcaattacgtgctgaacaagttttacaaaaacgtgcttttaaaaatccaaagatggactttacttgggatagtgaagtaaaagaaatcattggtgacgaaaataaaatgactggtgtaaaggttcataacaagaaaactggaaaagacgagactatagatgcaaacggagcttttatttacattgggaatattccaaatagtgaaccttttagagacttaaatattactgataaagatggctggattttgactaacgatcaaatggaaactgaagtaccaggaatctttgcaatcggtgatgttcgtaaaaagaaattacgtcaaattattactgccgttaatgatggtggtattgccggtcaaaacgcttatgaatacattcaaaaacttactgaaaat

SEQ ID NO: 154 - protein, 321 aa, Lactobacillus acidophilus
MKVNENIRGIDMKKYDVAIIGAGPGGMAAALYAARANLTVAMIDRGVYGGQMNNTAEVENYPGFPSILGPELGEKMYQNTVKQGVNFVYGDVQGIEVKDDKRIVKLGSEDSDIETKAVIIGTGSSNRKLGVPGEDEYSGKGVSYCAVCDGAFFKNENVVVVGGGDSAVSEGLYLANVTDNVNVIHRRDQLRAEQVLQKRAFKNPKMDFTWDSEVKEIIGDENKMTGVKVHNKKTGKDETIDANGAFIYIGNIPNSEPFRDLNITDKDGWILTNDQMETEVPGIFAIGDVRKKKLRQIITAVNDGGIAGQNAYEYIQKLTEN

SEQ ID NO: 155 - DNA, 309 bp, Lactobacillus acidophilus
  CDS (1)...(309)
  misc_feature (0)...(0): ORF 1901; Thioredoxin
atgaaacttttagaaagtaatttaaaaataaataatgcagttttatattttaacaatgatggatgttctctttgttataccgaaaagaaagttatccatgatctagagaagaatatgaagcagcaaataccaatttattcaattgatgcacgtaatcagaaagatttagtgaaaaaatacgaaattttatccgtaccaagtatcgtttttattaaaaatggtcaaaaggtagatcagtttaataaatatttaaatggcaaacaaattgaaacagtttttacttattatttcgggagtttagacaatgac

SEQ ID NO: 156 - protein, 103 aa, Lactobacillus acidophilus
MKLLESNLKINNAVLYFNNDGCSLCYTEKKVIHDLEKNMKQQIPIYSIDARNQKDLVKKYEILSVPSIVFIKNGQKVDQFNKYLNGKQIETVFTYYFGSLDND

SEQ ID NO: 157 - DNA, 2127 bp, Lactobacillus acidophilus
  CDS (1)...(2127)
  misc_feature (0)...(0): ORF 1910; ClpE-ATP-dependent protease/ATP-binding subunit
atggcatactttgataatgattttgacaatttatttaacgaattaaatagctcattctttaacgatgattttggaagcagaagaagcgataataacggcaattctggttctattcctatgaactactcaagtaacatgagttcttcaccacgtactattcaacaaaatccacaacaaccaaatgaaaagccaattggtgtagatttagttgaagaagctaagaacaacaagtttgacccagttattggtcgtgatgaacaaattgataacgtaattgaaattttatcaagacgtaagaagaataatcctgttttaattggacctgctggtgttggtaagacttctatcgtagaaggtttggctgaaagaattgccgctggtaatgttccagctaagatggctaacatgcacatcatttcagtaaacattaatgatatggttgctggctcaagtcttcgtggtagctttgaagaaagattaaagaaagttatcgacaaggctaagagtgaccctaacattgttttattcattgatgaattacacaacattgttggtgcaggttctactgattctgaaaataacaacggtgacgctgctaacattttgaaaccagctcttgcaagcggtgaattaaagttaatcggtgctactactacaagtgaattccaaagaattgaaaaggacccagctctttcacgtagattccaagctgttcaagttccagaaccttcaactgatgtagctatcaagattttggaaggcttgaagaagaaatacgaagactaccaccacgtaaaatacactgatgacagtcttaaattagctgtagaattatcagaaagatacattcaaggtcgttacttaccagataaagctatcgatttgatggatgaagctggtgctaagaaggctttgcttgtacaaccaactgatgaaaagagtcttaagaaccaaattagtgctcttgaagctaagaaggcagaagctgctaaggcagaagactatgacaaggctgctgaaatcaaagaaaagattgctagccttgaatcacaattaaagagcgtagatagcaagaatactccagaagtaactgcaaaagatatctaccaaattattgaacaaaagactaagattcctatgagtgaacttcacgctgatgaagctcaaaagaacttagacttggctaagaaattaaagaagaacgttattgaccaagatagagcaattgacgtaattactgacgctatcgctcgtaagcaaatcttcaaagacagcgatcgtcctactggttcattcttacttactggtcctacaggtgttggtaagactgaacttgctaagcaattagctattcaattatttggtaacaaggaacacttaatccgtttggatatgagtgaataccaagatgaaatggcagttaacaagttgattggttctgcaccaggttacgtaggctatggtgaaggtggtcaattaactgaaaaagttcgtcaccaaccatactcattgattttgtttgacgaaattgaaaaggctaacccacaagttttcaacgcacttcttcaaattatggatgacggtcgtttgactgatgcacaaggtagaactgtatcattcaaggatactatcttaattatgacttcaaacgctggattctcagacaagttgcttgaagacggtaaagttgatcaagacaagttaatctcagctcttgaaaactacttcagacctgaattcttaaaccgtttggacgcaatcgtaccattcaactcacttactgaacaagacatgggtaagattatcaacatttacttgaagaagatgtcacatgtacttgctaagaagggtgtaactgttgaagtttcagatgaagctaaagaattcttggcagaaaaaggttatgacaagaagttcggtgctcgtccacttagaagagttgttgaacaaaaccttgaaactccagctgctaagttaatcttaagagaacctgacactaagaagattgaattcactgctgacgacaagcacttatacttgaacggcaaggcaatctttgacatttctccaaaggttgaagaaaaagttaaggaagacgaagctaaagctgaaggcaaaaaagaagac

SEQ ID NO: 158 - protein, 709 aa, Lactobacillus acidophilus
MAYFDNDFDNLFNELNSSFFNDDFGSRRSDNNGNSGSIPMNYSSNMSSSPRTIQQNPQQPNEKPIGVDLVEEAKNNKFDPVIGRDEQIDNVIEILSRRKKNNPVLIGPAGVGKTSIVEGLAERIAAGNVPAKMANMHIISVNINDMVAGSSLRGSFEERLKKVIDKAKSDPNIVLFIDELHNIVGAGSTDSENNNGDAANILKPALASGELKLIGATTTSEFQRIEKDPALSRRFQAVQVPEPSTDVAIKILEGLKKKYEDYHHVKYTDDSLKLAVELSERYIQGRYLPDKAIDLMDEAGAKKALLVQPTDEKSLKNQISALEAKKAEAAKAEDYDKAAEIKEKIASLESQLKSVDSKNTPEVTAKDIYQIIEQKTKIPMSELHADEAQKNLDLAKKLKKNVIDQDRAIDVITDAIARKQIFKDSDRPTGSFLLTGPTGVGKTELAKQLAIQLFGNKEHLIRLDMSEYQDEMAVNKLIGSAPGYVGYGEGGQLTEKVRHQPYSLILFDEIEKANPQVFNALLQIMDDGRLTDAQGRTVSFKDTILIMTSNAGFSDKLLEDGKVDQDKLISALENYFRPEFLNRLDAIVPFNSLTEQDMGKIINIYLKKMSHVLAKKGVTVEVSDEAKEFLAEKGYDKKFGARPLRRVVEQNLETPAAKLILREPDTKKIEFTADDKHLYLNGKAIFDISPKVEEKVKEDEAKAEGKKED

SEQ ID NO: 159 - DNA, 1029 bp, Lactobacillus acidophilus
  CDS (1)...(1029)
  misc_feature (0)...(0): ORF 697; Transcriptional regulator
atggattcggacttttctttgctcgaagcgctcgttcccgacgtcttaaagatccttcgacaaaggtatcttgtccttgagcaaattgctttgcatgctccgataggtcgtcgaagtgttgctcagcatttaggactttcagaaagaaacattagaactgaaactgaatatttaagtcaattaggattaattgaaattaaaagttttggcatgtttttaactgaaaagggcgagaagacattaaaagatgcaggtctgttgattgatcgtctctttaatgctcgtgaaactgaagtagagttagctaaaaaacttggaattgaaagaacattaatagttccaggaaatgctgatttgcaggaccgagtttatgaggaaatgggagagaaattaagttcagctttgaatttactcttgccattaggtcattcaatagttacaattctaggtggagcttctttagcaaaatctgctaaatatttatctccagatcttggcaataatcgccaattagaatttgttcctggtcgaggagctctgggcgaaaatgtagagacgcaaagtaatacaatcgttcaagagatggcggctaaaacttcaggtacttataaaactttgtatttacctgaacaagtttcagctgatgcgtataagtcacttatacgggaaccttcgattgtggacgttctgcaagatatttcacaaagcgatgctgtaattcatggaattgggttagctcaagaaatggcacagcgtagaggttatgattcaattaaactttcagagcttcgtgaaaagaaagccgtcaccgaatgttttgggtgtttcttcgatgaaaatggtaaggttgttgaccgtatcacccaggttggattacagtttgacaatctatataaaataccccacatatttgcctttgcttgcggtgctaaaaaagctaaagcaattaaagcatatatgcccaatgcacctcatcaaacctggttaattactgatgaaggggcctcaaatatgattttaaaggggaaa

SEQ ID NO: 160 - protein, 343 aa, Lactobacillus acidophilus
MDSDFSLLEALVPDVLKILRQRYLVLEQIALHAPIGRRSVAQHLGLSERNIRTETEYLSQLGLIEIKSFGMFLTEKGEKTLKDAGLLIDRLFNARETEVELAKKLGIERTLIVPGNADLQDRVYEEMGEKLSSALNLLLPLGHSIVTILGGASLAKSAKYLSPDLGNNRQLEFVPGRGALGENVETQSNTIVQEMAAKTSGTYKTLYLPEQVSADAYKSLIREPSIVDVLQDISQSDAVIHGIGLAQEMAQRRGYDSIKLSELREKKAVTECFGCFFDENGKVVDRITQVGLQFDNLYKIPHIFAFACGAKKAKAIKAYMPNAPHQTWLITDEGASNMILKGK

SEQ ID NO: 161 - DNA, 1299 bp, Lactobacillus acidophilus
  CDS (1)...(1299)
  misc_feature (0)...(0): ORF 889; 2-phosphoglycerate dehydratase
ttgaggaggtttataatgctcaaatcagttattgaaaatgtacacgcactcgaaatttttgactcacgtggtaacccaactgttgaagttcacgttactctttcaaacggtgtcgtaggtaaggctgaagttccatcaggtgcttcaactggtgaaaacgaagctgttgaattacgtgacggtggttcacgtcttggtggtaagggtgtttcaaaggctgttaacaatgttaacactgaaattaacgacgctttaaagggtatggacccatttgaccaacctaagattgaccaaactatgatcgacttagatggtactccaaacaagggccgtcttggtgctaacgctatcttaggtgtatcaatggctactgctgttgctgcagctaacgctaaccgtcaacctctttaccgttaccttggcggtattgatcttgaaatgccacaaactttccacaacgttatcaacggtggtgaacacgctgacaacggtatcgacattcaagaattcatgattactccaattgctaagacttcattccgtgatggtttcgaaaagatcgttaacgtataccacactttgaagaaggttcttgaagacatgggttacgaaactggcttgggtgacgaaggtggtttcgcacctaacatgaagaactcagaagaagctttgaaggctttacacgaatcaatcatcaaggctggttacaagccaggtgaagatatcggtatcgcatgtgactgtgctgcttcatacttctacaacaaggaagatggtaagtaccaccttgaaggtaaggttcttactgatgatgaattagctgcatactacgacaagcttttggatgaattcccagaattaatgtcaatggaagacccatacgacgaaaacgatgttgaaggtatggttaagtttactgcaactcacaaggaccgtatccaaatcgttcttgacgacttcatttgtactaacccagcacttttgaagaaggctatcaaggaaggtgcaggtaacgcttcattaatcaagttgaaccaaattggtactgttactgaaactcttgaaactatccgtatgtcacgtaagaatggttacaacactatgatttcacaccgttcaggtgaaactggtgacacattcatcgctgacttggcagttgctataaacggtggtcaacttaagaccggtgctccagctcgttcagaacgtgttgaaaagtacaaccgcttacttgaaatcgaagaagaacttggcaagggcgaacgtcttgcattcttcccagatgatgttgaccacgat

SEQ ID NO: 162 - protein, 433 aa, Lactobacillus acidophilus
MRRFIMLKSVIENVHALEIFDSRGNPTVEVHVTLSNGVVGKAEVPSGASTGENEAVELRDGGSRLGGKGVSKAVNNVNTEINDALKGMDPFDQPKIDQTMIDLDGTPNKGRLGANAILGVSMATAVAAANANRQPLYRYLGGIDLEMPQTFHNVINGGEHADNGIDIQEFMITPIAKTSFRDGFEKIVNVYHTLKKVLEDMGYETGLGDEGGFAPNMKNSEEALKALHESIIKAGYKPGEDIGIACDCAASYFYNKEDGKYHLEGKVLTDDELAAYYDKLLDEFPELMSMEDPYDENDVEGMVKFTATHKDRIQIVLDDFICTNPALLKKAIKEGAGNASLIKLNQIGTVTETLETIRMSRKNGYNTMISHRSGETGDTFIADLAVAINGGQLKTGAPARSERVEKYNRLLEIEEELGKGERLAFFPDDVDHD

SEQ ID NO: 163 - DNA, 1215 bp, Lactobacillus acidophilus
  CDS (1)...(1215)
  misc_feature (0)...(0): ORF 845; ef-tu
ttgcaaatttacaggagggtcattttaatggcagaaaaagaacattacgttagaactaagccacacgtaaacattggtactatcggtcacgttgaccacggtaagaccactttaactgcggctattactactgttttagctgaaaagggattagctaaggctgaagattactcacaaatcgatgctgcacctgaagaaaaggaacgtggtatcactattaacaccgcccacgtagaatacgaaactgaaaatcgtcactacgctcacatggacgctccaggccacgccgactacatcaagaacatgattaccggtgcggctcaaatggatggtgctatcttagttgttgctgcaactgatggtcctatgccacaaactcgtgaacacattttgcttgctcgtcaagttggtgttaactacatcgtagtattcttgaacaagtgcgatttagttgacgacccagaattgatcgacttggttgaaatggaagttcgtgacttgttgactgaatacgattaccctggtgatgatattccagttgttcgtggttcagcattaaaggctttacaaggtgacaaggaagctcaagaccaaatcatgaagttgatggacattgttgatgaatacatcccaactccagaacgtcaaactgacaagccattcttgatgccagttgaagacgtattcactatcactggtcgtggtactgttgcttcaggtcgtatcgaccgtggtactgttaaggtcggtgacgaagttgaaatcgttggtttggtagataaagttcttaagtcagttgttactggtttggaaatgttccacaagactttggacttaggtgaagccggcgataacgttggtgtattgcttcgtggtgttgaccgtgatcaagttgttcgtggtcaagtattggctgcacccggctcaatccaaactcataagaagtttaaggcacaagtttatgttttgaagaaggacgaaggtggtcgtcacactccattcttctcagactaccgtccacaattctacttccacaccactgatattactggtgaaattgaattgccagaaggtactgaaatggttatgcctggtgataacactgaattcactgttactttgatcaagccagctgccatcgaaaagggtactaagttcaccatccgtgaaggtggtcgtaccgttggtgccggtcaagttactgaaatccttgac

SEQ ID NO: 164 - protein, 405 aa, Lactobacillus acidophilus
MQIYRRVILMAEKEHYVRTKPHVNIGTIGHVDHGKTTLTAAITTVLAEKGLAKAEDYSQIDAAPEEKERGITINTAHVEYETENRHYAHMDAPGHADYIKNMITGAAQMDGAILVVAATDGPMPQTREHILLARQVGVNYIVVFLNKCDLVDDPELIDLVEMEVRDLLTEYDYPGDDIPVVRGSALKALQGDKEAQDQIMKLMDIVDEYIPTPERQTDKPFLMPVEDVFTITGRGTVASGRIDRGTVKVGDEVEIVGLVDKVLKSVVTGLEMFHKTLDLGEAGDNVGVLLRGVDRDQVVRGQVLAAPGSIQTHKKFKAQVYVLKKDEGGRHTPFFSDYRPQFYFHTTDITGEIELPEGTEMVMPGDNTEFTVTLIKPAAIEKGTKFTIREGGRTVGAGQVTEILD

SEQ ID NO: 165 - DNA, 888 bp, Lactobacillus acidophilus
  CDS (1)...(888)
  misc_feature (0)...(0): ORF 958
atgcttggaactattgcaaaaggaaaaataattgataaaaatgataaagcttactatgttcaaatagatggcattacttatgagcttaagaagcatgaaattactcaagacgatattcccaaaattggtgatgtggttgaaggatttatttatgataataaagatcatgatcgtgaaatgacacaatttttaccttttgctcaaccagatcaatatgggtgggggaaagtgaccgaagttcgtccgggattaggtgtatttgttgatgtaggtcttccagataaggatgtagttgtttcaatggatgatttaccacgagaaaaagaaagatggccacgtcgtgatgatcagcttttagtacgattggaaactgattataaagatcgtatttgggcaaaattggctgatgaagatatttttgatcaattagcagctaatttcccacgtggtatgaataatcaaaatgtttttggtacagtttatgctagtcgtgatatcggtgcttttgtattaactaatgattattatcttggttttatccatgaatcacaaatgccaagaccgatgagacttggagaacaatttaaaggtcgagtaattggtgttagccaatatggacgtttgaatttaagtgcattaccacgtgcatttgaagaaattgatgatgatgcgcaaatgattttaatgagtttacgtagaagagaaactaaaacattgccattttatgacaaatctgatgctcaagagattaaagcttactttggaatttctaaatcagcatttaagagagcattaggtcatttacttaaagctggtttgattgaagaagataaggatgctggtactattactttgattaaggatccagaagagaatactgatgacgaa

SEQ ID NO: 166 - protein, 296 aa, Lactobacillus acidophilus
MLGTIAKGKIIDKNDKAYYVQIDGITYELKKHEITQDDIPKIGDVVEGFIYDNKDHDREMTQFLPFAQPDQYGWGKVTEVRPGLGVFVDVGLPDKDVVVSMDDLPREKERWPRRDDQLLVRLETDYKDRIWAKLADEDIFDQLAANFPRGMNNQNVFGTVYASRDIGAFVLTNDYYLGFIHESQMPRPMRLGEQFKGRVIGVSQYGRLNLSALPRAFEEIDDDAQMILMSLRRRETKTLPFYDKSDAQEIKAYFGISKSAFKRALGHLLKAGLIEEDKDAGTITLIKDPEENTDDE

SEQ ID NO: 167 - DNA, 1437 bp, Lactobacillus acidophilus
  CDS (1)...(1437)
  misc_feature (0)...(0): ORF 778; ATP synthase beta subunit
ttgagtgaaggtgaaatcgttcaagtaatcggccctgttgtcgatgtaaaattcccaatcgataagaatttacctgatattaacaacgccttacgtgtaatcaagtccgaagatgaaagcatcgttcttgaagttacacttgaactcggtgatggtgttttaagaacaatcgccatggaatctaccgatggtcttcgtcgtggtatgaaagtcgaagatactggcgctccaatttcagttccagttggagaagacactttaggtcgtgtgtttaacgttttaggacagcctattgatggtggtccagcctttccaaaggatcacccacgtgagggtatccacaaggaagcacctaaatatgaagatttaactactagtcgtgaaattcttgaaactggtatcaaggttatcgaccttcttgaaccatatgttcgtggtggtaaagttggtttgtttggtggtgccggtgttggtaaaactactattattcaagaattaattcacaacatcgctcaagaacacggtggtatttccgtatttactggtgttggtgaaagaactcgtgaaggtaatgacctttactttgaaatgaaagcttcaggcgttttaagtaagactgccatggtatttggtcagatgaacgagccgcctggtgccagaatgcgtgttgcattaaccggtttgacacttgctgaatactttagagatgttgaaggtcaagacgtattgctctttattgacaatatctttagatttactcaggctggttcagaggtatctgctttgcttggtcgtatgccaagtgccgtaggttatcagccaactttggcaacagaaatgggtcaattgcaggaaagaattacttctactaagaagggttcaattacttcaattcaagccgtttatgttcctgccgatgactatactgacccagctccatcaaccacattcgcatacttggatgctactactaacttggaacgtagtttagtagaacaaggtatttatccagctgttgatccacttgaatcatcttcaagtgcccttgatcctgaagttgttggtcaggaacactatgaagttgctactcgtgttcaacatgttttgcaacgttaccatgaattacaagatattatttctgttttaggtatggatgaattgtcagatgaagaaaaattgatcgttgctcgtgcacgtaaagttcaattcttcttgtcacaaaacttctttgttgcagaacaatttactggtgtaccaggttcatatgttccaattaaagaaaccattaagggctttaagcttatcttagatggtcaccttgatgatttaccagaagatgccttccgtggtgtcggcccaattgaagatgttttgaagaaagcacaagaaatgggtgtaactccaagtgatccagaagctaaagcattactagaaaag

SEQ ID NO: 168 - protein, 479 aa, Lactobacillus acidophilus
MSEGEIVQVIGPVVDVKFPIDKNLPDINNALRVIKSEDESIVLEVTLELGDGVLRTIAMESTDGLRRGMKVEDTGAPISVPVGEDTLGRVFNVLGQPIDGGPAFPKDHPREGIHKEAPKYEDLTTSREILETGIKVIDLLEPYVRGGKVGLFGGAGVGKTTIIQELIHNIAQEHGGISVFTGVGERTREGNDLYFEMKASGVLSKTAMVFGQMNEPPGARMRVALTGLTLAEYFRDVEGQDVLLFIDNIFRFTQAGSEVSALLGRMPSAVGYQPTLATEMGQLQERITSTKKGSITSIQAVYVPADDYTDPAPSTTFAYLDATTNLERSLVEQGIYPAVDPLESSSSALDPEVVGQEHYEVATRVQHVLQRYHELQDIISVLGMDELSDEEKLIVARARKVQFFLSQNFFVAEQFTGVPGSYVPIKETIKGFKLILDGHLDDLPEDAFRGVGPIEDVLKKAQEMGVTPSDPEAKALLEK

SEQ ID NO: 169 - DNA, 1332 bp, Lactobacillus acidophilus
  CDS (1)...(1332)
  misc_feature (0)...(0): ORF 169; S-layer slpA
atgaagaaaaatttaagaatcgttagcgctgctgctgctgctttacttgctgttgctccagttgctgcttctgctgtatctactgttagcgctgctactactattaacgcaagttcatcagcaatcaataccaacactaatgctaagtacgatgttgatgtaactcctagtgtttctgcagttgctgcaaatactgctaacaacactccagctattgccggtaaccttactggtactatttcagcaagttacaatggtaagacttatactgctaacttaaaggcagatactgaaaatgccactattactgctgctggtagcactactgccgttaaacctgctgaattagctgcaggtgtggcttacactgtaactgttaacgatgtttcatttaacttcggttcagaaaatgcaggtaagactgttacccttggttcagctaactcaaatgtaaaattcaccggtacaaacagtgataatcaaactgaaactaatgtttctactttgaaagttaagttagaccaaaacggtgttgcttcacttactaatgtttcaattgcaaacgtatacgcaattaacactactgataacagtaacgtaaacttctacgacgtaactagtggtgctactgtaactaacggtgccgtttcagttaatgctgataaccaaggtcaagttaatgttgcaaacgtagttgcagcaattaattcaaaatactttgcagcacaatacgcagataagaagttaaatactcgtactgctaatactgaagatgctattaaggcagccttaaaggaccaaaagattgatgtaaactcagtaggttacttcaaagcacctcatactttcactgttaacgttaaagcaacttcaaatactaatggtaagtcagctactttgccagtagttgttactgttcctaatgttgctgagccaactgtagccagcgtaagcaagagaattatgcacaacgcatactactacgacaaggacgctaagcgtgttggtactgacagcgttaagcgttacaactcagtaagcgtattgccaaacactactactatcaacggtaagacttactaccaagtagttgaaaacggtaaggctgttgacaagtacatcaacgctgcaaacatcgatggtactaagcgtactttgaagcacaacgcttacgtttacgcatcatcaaagaagcgtgctaacaaggttgtattgaagaagggtgaagttgtaactacttacggtgcttcatacacattcaagaacggccaaaagtactacaagatcggtgacaacactgacaagacttacgttaaggttgcaaactttaga

SEQ ID NO: 170 - protein, 444 aa, Lactobacillus acidophilus
MKKNLRIVSAAAAALLAVAPVAASAVSTVSAATTINASSSAINTNTNAKYDVDVTPSVSAVAANTANNTPAIAGNLTGTISASYNGKTYTANLKADTENATITAAGSTTAVKPAELAAGVAYTVTVNDVSFNFGSENAGKTVTLGSANSNVKFTGTNSDNQTETNVSTLKVKLDQNGVASLTNVSIANVYAINTTDNSNVNFYDVTSGATVTNGAVSVNADNQGQVNVANVVAAINSKYFAAQYADKKLNTRTANTEDAIKAALKDQKIDVNSVGYFKAPHTFTVNVKATSNTNGKSATLPVVVTVPNVAEPTVASVSKRIMHNAYYYDKDAKRVGTDSVKRYNSVSVLPNTTTINGKTYYQVVENGKAVDKYINAANIDGTKRTLKHNAYVYASSKKRANKVVLKKGEVVTTYGASYTFKNGQKYYKIGDNTDKTYVKVANFR

SEQ ID NO: 171 - DNA, 2415 bp, Lactobacillus acidophilus
  CDS (1)...(2415)
  misc_feature (0)...(0): ORF 600; xylulose-5-phosphate/fructose phosphoketolase
gtgctcaaaggagaaaaaatgacagttaattacgattccaaagattacttaaagagcgttgacgcatattggcgtgcagctaattatttgtcagttggacaattatttttaatgaaaaatccgttgttaaagaaacctttaacagctgaagatgtaaaacctaagccaatcggtcactggggtactattgctccacaaaactttatttatgctcacttaaatcgtgcgcttaaaaaatatgacttggatatgttctatattgaaggttcaggtcacggtggccaagtgatggtttcaaattcatatcttgatggttcatatactgaacgttatccagaaattacccaagatgaaaagggtatggctaaattgtttaagcgctttagtttcccaggtggtgtagcttctcacgctgctcctgaaactccaggttctattcatgaaggtggggaattaggatacgcactttcacatggggtaggtgctattttagacaatccagatgtaattgctgccgttgaaattggtgatggtgaagcagaaactggtccacttgcagctagctggttcagtgacaagtttattaatccaattaaggatggtgcagttttaccaattcttcaaattaatggtttcaagatttctaacccaactatcgtttcaagaatgagcgatgaagaattaactgaatacttccgtggcatgggttgggatccgcactttgtttcagtatttaagggtggccgctttgacggtgaaaaggatccaatgcaagtccacgaagaaatggctaaaaccatggacgaagtaattgaagaaattaaggctattcaaaagcatgctcgtgaaaataatgatgctactttgccacattggccattgattatcttccaatgtccaaagggctggaccggtccaaagaaggatcttgacggcaatccaattgaaaactcatttagagcacaccaaattccaattcctgtctcacaatacgatatgaaacatgttgatatgttgactgattggcttgaaagttataagccaaacgaattattcaacgaagatggttcaccaaaggaaattgttactgaaaacactgctaagggtgatcaacgtatggcaatgaatccgatcactaatggtggtaaggatcctaaacgattgaacctaccagattatcgcaactttgcacttaagtttgacaagccaggttcagttgaagcacaagacatggttgaatgggctaaatatttaaacgaagttgctaaacttaacccaactactttccgtggctttggtcctgatgaatctaaatcaaaccgtttatttaaacttttagatgatcaaaagcgtcaatgggaacctgaagttcatgaaccaaatgatgaaaacttggcaccaagtggccgcgttatcgattcacaattatcagaacaccaagacgaaggcttccttgaaggctacgttttaactggtcgtcacggcttctttgcaacctacgaagcatttggtcgtgtagtagattcgatgcttactcaacatatgaagtggcttagaaaagctaaagaacaatattggcgtcatgattatccatcacttaactttgttgctacttcaacagtattccaacaagatcacaatggttacactcaccaagatccaggcattttaactcacttatatgaaaagaatcgtccagatttagttcatgaatacttgccatcagatactaatactttacttgctgtaggtaacaaggcatttactgatcgtgaatgtattaatgttttagtaacttcaaagcaacctcgtccacaatggttctcaattgaggaagcacaaaagttagttgataaaggtttaagttacattgattgggcttcaactgataaaggtgtaaaaccagatattgtctttgcttcaacagaaactgaaccaacaattgaaactttggcagcaattgatattttgcatgacaagttcccagatcttaagattcgctacattaacgtaattgatgtgatgaaattaatgtcaccaaaggacaataagaatggtatttctgatgaagaatttgatcgcttattcccaaaggacgttcctgtaatctttgcatggcacggctacaagagtatgatggaatcaatttggtttgcacgtaaccgtcataatgtacatattcactgctacgaagaaaacggtgatattactaccccatttgatatgcgtgttttgaaccaccttgacagatttgatcttgccaaagatgctgttgaaagtgttgataaattgaagggcaagaacgctgactttatcagtcatatggatgacttgcttgaaaagcaccaccaatacattcgtgataatggtaaagatatgccagaagttactgaatggaagtggaagggcttgaag

SEQ ID NO: 172 - protein, 805 aa, Lactobacillus acidophilus
MLKGEKMTVNYDSKDYLKSVDAYWRAANYLSVGQLFLMKNPLLKKPLTAEDVKPKPIGHWGTIAPQNFIYAHLNRALKKYDLDMFYIEGSGHGGQVMVSNSYLDGSYTERYPEITQDEKGMAKLFKRFSFPGGVASHAAPETPGSIHEGGELGYALSHGVGAILDNPDVIAAVEIGDGEAETGPLAASWFSDKFINPIKDGAVLPILQINGFKISNPTIVSRMSDEELTEYFRGMGWDPHFVSVFKGGRFDGEKDPMQVHEEMAKTMDEVIEEIKAIQKHARENNDATLPHWPLIIFQCPKGWTGPKKDLDGNPIENSFRAHQIPIPVSQYDMKHVDMLTDWLESYKPNELFNEDGSPKEIVTENTAKGDQRMAMNPITNGGKDPKRLNLPDYRNFALKFDKPGSVEAQDMVEWAKYLNEVAKLNPTTFRGFGPDESKSNRLFKLLDDQKRQWEPEVHEPNDENLAPSGRVIDSQLSEHQDEGFLEGYVLTGRHGFFATYEAFGRVVDSMLTQHMKWLRKAKEQYWRHDYPSLNFVATSTVFQQDHNGYTHQDPGILTHLYEKNRPDLVHEYLPSDTNTLLAVGNKAFTDRECINVLVTSKQPRPQWFSIEEAQKLVDKGLSYIDWASTDKGVKPDIVFASTETEPTIETLAAIDILHDKFPDLKIRYINVIDVMKLMSPKDNKNGISDEEFDRLFPKDVPVIFAWHGYKSMMESIWFARNRHNVHIHCYEENGDITTPFDMRVLNHLDRFDLAKDAVESVDKLKGKNADFISHMDDLLEKHHQYIRDNGKDMPEVTEWKWKGLK

SEQ ID NO: 173 - DNA, 990 bp, Lactobacillus acidophilus
  CDS (1)...(990)
  misc_feature (0)...(0): ORF 1469; UDP-glucose 4-epimerase
atgaaagttttagttgtaggtggtgcgggctacattggctcacatgccgttcgtgaattagtcaaagaaggtaatgatgtcgttgtactcgactctttatacaccggtcacagaaaggctgtcgatcctaaagcaaagttttatcaaggcgacatcgaggatactttcttagtatcaaagattttacgtgatgaaaaaattgacgctgtaatgcattttgcagcttattcattagtacccgaatcagttaaaaaaccacttaaatactacgataacaatgtttctggtatgatttcattattaaaagcaatgaatgatgcagatgtgaaatatttagtattctcaagttctgcagctacttacggtattcctaagaagttgccaattactgaagatactccacttgatccaattaacccatatggtgaaactaagatgatgatggaaaagatcatggcttgggctgacaaagctgacggtattaaatatactgctcttcgttacttcaatgtagctggtgcttcaagcgatggtactattggtgaagatcacggtcccgaaactcaccttattccaaatattttgaagagtgccatttcaggtgatggtaagtttactatcttcggcgatgattacaataccaaggatggtactaacgtccgtgattatgttcaagttgaagacttaattgatgctcacattttagcattgaagcatatgatgaagactaataaatctgacgtattcaatttaggtaccgcacaaggttactctaacttagaaatcttagaaagtgctaaaaaagttactggtattgatattccgtatacaatggggcctcgccgtggcggtgatcctgattcactagttgccgactcaactaaggcaagaactattttaggctggaagccaaaacatgaaaatgttgatgaagtaatcgaaaccgcttggaagtggcacaagagtcacccaaagggctacgaagacaag

SEQ ID NO: 174 - protein, 330 aa, Lactobacillus acidophilus
MKVLVVGGAGYIGSHAVRELVKEGNDVVVLDSLYTGHRKAVDPKAKFYQGDIEDTFLVSKILRDEKIDAVMHFAAYSLVPESVKKPLKYYDNNVSGMISLLKAMNDADVKYLVFSSSAATYGIPKKLPITEDTPLDPINPYGETKMMMEKIMAWADKADGIKYTALRYFNVAGASSDGTIGEDHGPETHLIPNILKSAISGDGKFTIFGDDYNTKDGTNVRDYVQVEDLIDAHILALKHMMKTNKSDVFNLGTAQGYSNLEILESAKKVTGIDIPYTMGPRRGGDPDSLVADSTKARTILGWKPKHENVDEVIETAWKWHKSHPKGYEDK

SEQ ID NO: 175 - DNA, 1518 bp, Lactobacillus acidophilus
  CDS (1)...(1518)
  misc_feature (0)...(0): ORF 776; ATP synthase alpha subunit
gtgaaaccattgagcattaaagcggaagaaattagctccttgatcaagcaacaacttgaacattacgatgataagctcgatatcaacgaagttggtgttgtaacttatgttggtgatggtatcgcccgagctcacggactagatgatgtattgtctggtgagttattaaaatttgataacggttcatttggtattgctcaaaaccttgaatcaaatgatgttggtatcattattttaggtcaatttgacaatattcgtgaaggtgaccgtgttcaaagaactggtcgaatcatggaagttcctgttggtgacgccttaatcggtagagtagttaacccattgggtcaaccagtggacggtttaggtgaaattaagtctgacaagactcgtcctattgaagctaaagctccaggtgttatggaccgtcaatcagttaatcaaccacttcaaactggtattaaggctattgatgccttagttcctattggtcgtggtcagcgtgaattgattattggtgaccgtaagactggtaagactagtttggctattgatactatccttaatcaaaaaggacaagacgtaatttgtatttacgttgctattggtcaaaaggaatcaaccgttagaactcaagtagaaactttaaagcgttttggcgcaatggattacactattgttgttgaagcgggcccaagcgaaccagctcctatgctttatattgcaccatatgctggtaccgcaatgggtgaagaatttatgtacaatggcaaggatgtattgatcgtatttgacgacctatccaagcaagctgttgcttaccgtgaactttccttgcttctccgtcgtccgcctggtcgtgaagcttatccaggtgacgtcttctacttgcactcacgtttacttgaacgtagtgctaagttaagtgacaaacttggtggtggatcattgacagctttgccaattattcaaactgaagccggagatatttctgcatatattccaaccaacgtaatttcaattactgacgggcagattttcttgcaaagtgatttattctttgctggtactcgtccagctattgacgctggtaactcagtttctcgtgttggtggtaatgctcagatcaaggcaatgaagaaggttgctggtactttacgtactgaccttactgcttatcgcgaacttgaaagtttcgcccaatttggtagtgatcttgatcaagcaactcaagctaagcttaatagaggtcaaagaactgttgaagttttgaagcaaccacttcatgatccaattcctgtagaaaagcaagttttaattctttatgctttgactcatggctatcttgatgctattccagtcgaagacattagtcgtttccaaaatgaattgtttgataattttgatagcagtcatgctgatttgcttaagacaattcgtgaaaccggtaaattaccagatgacaaggaattatcagcagctattgaggaattcagtgaaagctttacaccaagtgaaaaa

SEQ ID NO: 176 - protein, 506 aa, Lactobacillus acidophilus
MKPLSIKAEEISSLIKQQLEHYDDKLDINEVGVVTYVGDGIARAHGLDDVLSGELLKFDNGSFGIAQNLESNDVGIIILGQFDNIREGDRVQRTGRIMEVPVGDALIGRVVNPLGQPVDGLGEIKSDKTRPIEAKAPGVMDRQSVNQPLQTGIKAIDALVPIGRGQRELIIGDRKTGKTSLAIDTILNQKGQDVICIYVAIGQKESTVRTQVETLKRFGAMDYTIVVEAGPSEPAPMLYIAPYAGTAMGEEFMYNGKDVLIVFDDLSKQAVAYRELSLLLRRPPGREAYPGDVFYLHSRLLERSAKLSDKLGGGSLTALPIIQTEAGDISAYIPTNVISITDGQIFLQSDLFFAGTRPAIDAGNSVSRVGGNAQIKAMKKVAGTLRTDLTAYRELESFAQFGSDLDQATQAKLNRGQRTVEVLKQPLHDPIPVEKQVLILYALTHGYLDAIPVEDISRFQNELFDNFDSSHADLLKTIRETGKLPDDKELSAAIEEFSESFTPSEK

SEQ ID NO: 177 - DNA, 711 bp, Lactobacillus acidophilus
  CDS (1)...(711)
  misc_feature (0)...(0): ORF 772; H+-transporting ATP synthase chain a
atggagaaatcatttgtttttaaattcatgggcttgaattttgatcttactgggatcattggttcaacgctaatggctttggcagtttttcttatctgcgtttggcttgcacgaaaagtagaaatgaaaccaaataaaagacaaaatgtatttgaatatctattagattttactgacggtattgtaaaagataacgttagcgatgtagatgctcagaagcacttgtcattatatgctttcgttttattccttttcatttggtttatgaaccaattgggaatgttcctagaagtcaaagttgatgattgggtgtttattaaatcaccaactgccgatccagtagcgacaatgtcgtttgcaatgatgaccttgcttctatcgttcacattcggcgtacaaagatttggtgtaggcggatatttaaagaattatgcgcaaccagttggttttttacttccagttaatgtaattgaagaatttaccaacttcttaaccttatcattacgtctttatgggaatatatatgctggtgaagttttgctaacattaattggtaatgatctagcacatgctggtggaccatttacattgattctagcagctccattagccatggtttggcaaggtttctctgtcttcattggctctatccaggcatatgttttcgtaactttgtcaatggtttacattggtaagaaagttactacagaa

SEQ ID NO: 178 - protein, 237 aa, Lactobacillus acidophilus
MEKSFVFKFMGLNFDLTGIIGSTLMALAVFLICVWLARKVEMKPNKRQNVFEYLLDFTDGIVKDNVSDVDAQKHLSLYAFVLFLFIWFMNQLGMFLEVKVDDWVFIKSPTADPVATMSFAMMTLLLSFTFGVQRFGVGGYLKNYAQPVGFLLPVNVIEEFTNFLTLSLRLYGNIYAGEVLLTLIGNDLAHAGGPFTLILAAPLAMVWQGFSVFIGSIQAYVFVTLSMVYIGKKVTTE

SEQ ID NO: 179 - DNA, 285 bp, Lactobacillus acidophilus
  CDS (1)...(285)
  misc_feature (0)...(0): ORF 970; DNA-binding protein II HB
gtgaaattatttatggcaaataaagctgaattagtttctgaagttgcttcaaagactaagttgaccaagaaagaagttgctgctgcagtagatgctatctttggctcaattcaagacaatcttgctaagggtgaaaaggtacaattaatcggttttggtacttttgaagtacgtcaccgtgctgcacgtaaaggccgcaacccacaaactggtgatgaaatcgaaatcccagcaagtgaagtacctgcatttaagccaggtaaggctcttaaggaagctgttaag

SEQ ID NO: 180 - protein, 95 aa, Lactobacillus acidophilus
MKLFMANKAELVSEVASKTKLTKKEVAAAVDAIFGSIQDNLAKGEKVQLIGFGTFEVRHRAARKGRNPQTGDEIEIPASEVPAFKPGKALKEAVK

SEQ ID NO: 181 - DNA, 1335 bp, Lactobacillus acidophilus
  CDS (1)...(1335)
  misc_feature (0)...(0): ORF 752; glucose-6-phosphate isomerase
atgagtttaattaaatttgatagtagtaagttaactccatttattcatgaaaatgaattatctgaaatgcaagcaatggttaatgctgctaatgaagaattacgtgatggtactggtgcaggcagcgatttccgcggttggttaaatttgccagttgattacgacaaagaagaatttgaccgtatcaagaaagcagctaagaagatccaatcagattcagatgttttgatttgtattggtatcggtggttcataccttggtgcacaagctgcaattgaattcttgaatagcaatttctacggcaaggaagacaatggcatgccaactgttgtattctgtggtaactcactctcaggttcatacctctatgaccttattgaatgggtaggtgacaaggactttagtattaacgtaatttctaagtcaggtactactactgaaccatcagtagcattccgtatcttcaaggacaagttaatcaagaaatacggtaaggaagaagctgctaagagaatttacgcaactactgaccgtcaaaagggtgctttgaagactgaagctgatgcagaaggctacgaagaatttgtagttccagatgacattggtggtcgttacagtgttcttactgctgttggtttacttccaattgctgcttcaggtgctgatattgatgaattaatgaagggtgcagcagatgctcgtgctgattacactgatactgatttgtcaaaggctactccataccaatacgcagcaatccgtaacattctttaccgcaagggttacactactgaaattgtagaaaactacgaaccaagtttaagaatgtttggtgaatggtgcaagcaattaatgggtgaatcagaaggtaaggatcaaaagggtatttggccatcaagtgctaactttactactgaccttcactcacttggtcaatacatccaagaaggtttacgtaacttatttgaaactgttattcgtgttgaaaatccacgtcatgatgttaagattccaggcgatgaaaagaacttggatcaacttaacttcttggaaggcaagagcttaaactacgtaaacgatcgtgcttacgaaggtgttgttttggctcacactgatggtggtgttccagttatgactattaatattccagatcaaactgcacatactttaggttatatgatttacttctttgaattagctattgctatttcaggttacttgaatggtattaatccattcaatcaaccaggtgttgaagcatacaagcgtaacatgtttggtcttcttaataagccaggctacgaaaacttacacgacgacttagctaagcgtctt

SEQ ID NO: 182 - protein, 445 aa, Lactobacillus acidophilus
MSLIKFDSSKLTPFIHENELSEMQAMVNAANEELRDGTGAGSDFRGWLNLPVDYDKEEFDRIKKAAKKIQSDSDVLICIGIGGSYLGAQAAIEFLNSNFYGKEDNGMPTVVFCGNSLSGSYLYDLIEWVGDKDFSINVISKSGTTTEPSVAFRIFKDKLIKKYGKEEAAKRIYATTDRQKGALKTEADAEGYEEFVVPDDIGGRYSVLTAVGLLPIAASGADIDELMKGAADARADYTDTDLSKATPYQYAAIRNILYRKGYTTEIVENYEPSLRMFGEWCKQLMGESEGKDQKGIWPSSANFTTDLHSLGQYIQEGLRNLFETVIRVENPRHDVKIPGDEKNLDQLNFLEGKSLNYVNDRAYEGVVLAHTDGGVPVMTINIPDQTAHTLGYMIYFFELAIAISGYLNGINPFNQPGVEAYKRNMFGLLNKPGYENLHDDLAKRL

SEQ ID NO: 183 - DNA, 1731 bp, Lactobacillus acidophilus
  CDS (1)...(1731)
  misc_feature (0)...(0): ORF 640; p-enolpyruvate-protein p-transferase pt1
atgaccaagactttaaaaggaattgctgctagtgatggtattgccattgctccagcatatcttcttgtggagcctgatctttcattctcaaagtcttcagtcgacgacattgatgctgaagtagcacgttataacgatgctattaaggaatcaactgccgaagttgaaaaaattcgtgatattgctaagaagagcttgggtgaagaagaatcccaagtttttgaagcacacttaatgattttgaacgatccagaatttactggtgcaattgagaatgaaattaaggattcaaagattaatgcagaagctgcccttgatgaaactgcacaaaagtttattgctatttttgaagggatgactgataatccttatatgcaagaacgtgcagctgatgtacgtgatgtttcaaagcgtattatggctcacttacttggtaaagaattaccaaacccagcttcaattgatcacgaagttattgttgtagcacatgacttgactccaagtgatactgcacaacttaacaagaaatacgttaaaggctttattactgatgttggtggtcgtaccgctcactcagcaattatggctcgttcacttgaattgccagctgttgttggtactgattcaatcaccaaagacgttaaaaacggcgacatgttaattgatgacggtcttgacggtgtagctattatttcaccaagtgaagaacaaatagctgactacaagaaaaagggtgaagacttccttaagcaaaaggctgaatggaagaagttaaaggatgaaccatcagtaactgcagatggtaagcaatttattattgctgcaaacatcggtactcctaacgatatgccaggtgtacatgaaaacggtgctgaagctattggtttgtacagaactgaatttttgtacatggattcatcagacttcccaactgaagatgatcaattcgaagcctacaagaaagttattgaaggtatgaacggcaagcaagttgttatcagaactatggatattggtggtgataagcaccttgattactgggatttaccagaagaaatgaatccattcttaggtgtacgtgctattcgtctttcacttatgaatgaagaaattttccgtacccaattaagagccttactccgtgcttccgcatatggtaagcttggtattatgttcccaatggttggtacattagctgaacttcgtaaggctaaggctattttaaacgatgaaaagcaaaaacttgttgaaaagggagttaagatcggtgacaacttacaagttggtatgatgatcgaagttcctgctgcagctgttttggctgatcaatttgctaaagaagttgatttcttctcaatcggtactaatgacttgatccaatatactatggctgctgaccgtggtaatgataacgtatcatacttgtaccaaccatataacccatcagtacttcgtttgattaagcacactattgatgctgctcatgaaaatggtatttggtgtggtatgtgtggtgaagctgctggtgataacaccatgttcccaattttactttcaatgggacttgatgaatactcaatgagcgcaacttcaatcttacgtattagaagcttaatgaagaagcttgataccaaagatcttaaggaattagctaatgaagcttgttttgtttcagaaactgctgaagaaaacgaaaaattagttaacgacttaatgaagaaaattaacaag

SEQ ID NO: 184 - protein, 577 aa, Lactobacillus acidophilus
MTKTLKGIAASDGIAIAPAYLLVEPDLSFSKSSVDDIDAEVARYNDAIKESTAEVEKIRDIAKKSLGEEESQVFEAHLMILNDPEFTGAIENEIKDSKINAEAALDETAQKFIAIFEGMTDNPYMQERAADVRDVSKRIMAHLLGKELPNPASIDHEVIVVAHDLTPSDTAQLNKKYVKGFITDVGGRTAHSAIMARSLELPAVVGTDSITKDVKNGDMLIDDGLDGVAIISPSEEQIADYKKKGEDFLKQKAEWKKLKDEPSVTADGKQFIIAANIGTPNDMPGVHENGAEAIGLYRTEFLYMDSSDFPTEDDQFEAYKKVIEGMNGKQVVIRTMDIGGDKHLDYWDLPEEMNPFLGVRAIRLSLMNEEIFRTQLRALLRASAYGKLGIMFPMVGTLAELRKAKAILNDEKQKLVEKGVKIGDNLQVGMMIEVPAAAVLADQFAKEVDFFSIGTNDLIQYTMAADRGNDNVSYLYQPYNPSVLRLIKHTIDAAHENGIWCGMCGEAAGDNTMFPILLSMGLDEYSMSATSILRIRSLMKKLDTKDLKELANEACFVSETAEENEKLVNDLMKKINK

SEQ ID NO: 185 - DNA, 1224 bp, Lactobacillus acidophilus
  CDS (1)...(1224)
  misc_feature (0)...(0): ORF 699; phosphoglycerate kinase
ttgaggagaatattaatggctaaattaatcatttcagacctcgacgttaaaggtaaaaaagttttagtacgtgtagactttaatgttcctattaaagatggcgttattggtgatgataaccgtatcgttgctgcacttcctactattaagtacattattgaacatggtggtaaggcaattttgcttagccacttaggtcgtgtaaagtcagatgctgataagaaggaattgtcattgaagccagttgctgaacgtttaagcgaacttcttgacaagcctgtaacttttgtaccatcaaacgaaggtaaagaagttgaagaagcaatcgacaacatgaaagacggagatgttgttgttcttgaaaacactagattccaagatatcgacaacgatttcggtaagcgtgaatcaggtaacgatccaaaacttggcgaatactgggcaagtcttggcgatatctttgtaaacgatgctttcggtactgcacacagaagtcacgcttcaaacgttggtattgcaaccgctatgaaggaaaatggtaagcctgctgcagctggttacttacttgaaaaggaaattaagtacttaggtgacgccgttgataatcctgtacacccatttgttactattttgggtggtgctaaggtttcagacaagatcggtgttatcgaaaacttgattcctaagtcagatcacatcttaattggtggtggtatggcttacacattcttagctgctcaaggtcacaagattggtaaatcattatttgaagctgataaggttgatcttgctaaggaattgcttgaaaaggctggcgacaagatcgttcttccagttgacaacgtagctgcaactgaattctcaaacgatgcttcacgtgaagttgttggtgacgacattcctgataatatgatgggtcttgacattggtcctaagactattgctaagtttaaggacatcttaaaggatgctaagactgttgtttggaatggaccaatgggtgctttcgaaatgcctaactttgctgaaggtactttagaagtaggtcgtgctttggcaaaccttactgacgcaactactattatcggtggtggtgactcaactgctgctgctaagcaattgggtatcgcacctaagattagccacatttcaactggtggtggtgcttcacttaactaccttgaaggtaaagtattgccaggtatcgcttgcgtttcagacaag

SEQ ID NO: 186 - protein, 408 aa, Lactobacillus acidophilus
MRRILMAKLIISDLDVKGKKVLVRVDFNVPIKDGVIGDDNRIVAALPTIKYIIEHGGKAILLSHLGRVKSDADKKELSLKPVAERLSELLDKPVTFVPSNEGKEVEEAIDNMKDGDVVVLENTRFQDIDNDFGKRESGNDPKLGEYWASLGDIFVNDAFGTAHRSHASNVGIATAMKENGKPAAAGYLLEKEIKYLGDAVDNPVHPFVTILGGAKVSDKIGVIENLIPKSDHILIGGGMAYTFLAAQGHKIGKSLFEADKVDLAKELLEKAGDKIVLPVDNVAATEFSNDASREVVGDDIPDNMMGLDIGPKTIAKFKDILKDAKTVVWNGPMGAFEMPNFAEGTLEVGRALANLTDATTIIGGGDSTAAAKQLGIAPKISHISTGGGASLNYLEGKVLPGIACVSDK

SEQ ID NO: 187 - DNA, 1185 bp, Lactobacillus acidophilus
  CDS (1)...(1185)
  misc_feature (0)...(0): ORF 656; permease
atgaattataaaaaacataggggtgaaaccttatttaaaagatggttcctaaataaccgttttagtattgttttattaaacatcttattattcttcttaattatttgggtttttaataaaatatcatttgtattgaatcctgcttgggtatttttcagtgcgattttaccgccattacttttagcacttattcaatactatattatgaatcctgttgtagattggttcgaaaagaaattcagagttccaagagtattaacaattattgttttattcttgttcgtagttattgctatgatctggattattaatattctggttcctattgcacaacatcagattaattcattggttaaaaactggcctcatatctggaatgatgcagttaatgctacgcaaaatgcattgcgtgatccacgtcttcattcggttaagggtagtatccaaggtatgattgatgatacgcaaaagactctatttaagtctggacaaaatactgtaaattcaactttaggcaatatttcctctgctgtaagtattattacgatgatagtaatgactttgcttactgcaccgttcatattattctttatgcttaaagatggtcatcagttacgtccatatattactaaatttgtgccagaaacttggcaacaaagttttagtaaattgctgtatgatattaattatgctgtagcctcatatattcgtggtcaaattacggttgccttttgggtaggcgttatgtttacgatcggctatataattattgggttaccatatggtttggccttagctattttggctggatttatgaatttaattccatactttggtacaccacttgctttaattcctgtaattgtaatttcaattatgacttcaggctcaatgctggttaaagtattaattgtttttgcaatcgaacaaacaattgaaacaagaattttgagtccattggttatggggaataagatgcaaatgcatcctgttaccacaatcttacttttaatcggtgcaagttctgtatgggggctttggggtgttattttcggtattccgatctatgccgtcttgaagattattgtgtcccgcgtgtacaattattatcgaagagaatctgatatttttagtaacgaagatgctgcttctttaaccacgggggatgcagatgaaagtaagaaa

SEQ ID NO: 188 - protein, 395 aa, Lactobacillus acidophilus
MNYKKHRGETLFKRWFLNNRFSIVLLNILLFFLIIWVFNKISFVLNPAWVFFSAILPPLLLALIQYYIMNPVVDWFEKKFRVPRVLTIIVLFLFVVIAMIWIINILVPIAQHQINSLVKNWPHIWNDAVNATQNALRDPRLHSVKGSIQGMIDDTQKTLFKSGQNTVNSTLGNISSAVSIITMIVMTLLTAPFILFFMLKDGHQLRPYITKFVPETWQQSFSKLLYDINYAVASYIRGQITVAFWVGVMFTIGYIIIGLPYGLALAILAGFMNLIPYFGTPLALIPVIVISIMTSGSMLVKVLIVFAIEQTIETRILSPLVMGNKMQMHPVTTILLLIGASSVWGLWGVIFGIPIYAVLKIIVSRVYNYYRRESDIFSNEDAASLTTGDADESKK

SEQ ID NO: 189 - DNA, 1755 bp, Lactobacillus acidophilus
  CDS (1)...(1755)
  misc_feature (0)...(0): ORF 1300; oligopeptide ABC transporter; substrate-binding protein OppA
atgaaaaaggcaaaaatttttgctggtattacactattatcaggtgtagctcttactttagctgcttgtggtaattcagaatctaattctaatgaatcttctactgcagctaagtttagttcagcagtaccaaagaaggctactaaaaatggtggtactgtaaaggtagctgttgaaactgataccccatttactggtatctttaatgatgaactttcaacttcagcaactgatactggagttatgcaatatggtgctgaatcactttttgctacagatgatcaatatgtctttactgataaaggtgcagctactattaagattaaccaaaaggctaagactgcaactattaatattaagaaaaatgttaagtggtcagatggtaagcctgtaactgctaaagactatgaatatgcttacgaaattattgctaacaaggcaactaagtcacaacgttatacttcaagtttagctgacttagtaggtcttgaagaatatcatgaaggtaagtcaaatactatttcaggtattgaaatgccagatggtgacaatggtcgtaaagttattcttcactttaagactatgaaacctggtatgaatactagtggtaatggttatatctggggaacagcagctccatatcactacttaaaggatgttaaatttaaagatttaatgtcaagtgacaagattcgtaagaaacctttattctttggcgcatacaagcttcaaaaagttgttcgtggtcaatcagtaacctgggttcctaacgaatactactacaagggtaaaccaaagcttagcaagattactgctagtgtaattaaccctaattcagttgctcaaagtattaagtcaaataagtttgatgtaatctcagttattaactcacaatggcaaaatgtaaagggaactaagggcgtaaactttattgctcaagttccactctcatactcataccttggctttaaggttggtaaatgggatgctcaaaggggcgaaaatgttatgaatcctaagtcaaagatgaataacaaggctcttcgtcaagctattgcatatggtatgaatgttgatcaagtttacaagcgttacacatatggcttaagctttagagtccctactttaattcctaagcaatttggtgactacttcgataagaatgtaaagggctatagctacaacattaaaaagggtaacgaaatcttagacaaggctggatttaagaagaaaggaacttaccgtgtacaaccaaatggtaaacctttaactatccgtcttgctgctatgactggtaactcaactcaagaaccaatcgttcaaaactacatccaacaatggaagaaggaaggtttgaacgttaaattaactggcggtcgtttaattgaatttaattcattctatgacaagattcaaaatgatgatccatcagttgatatgttcttaggtgcatggtcactttcaagtgaaccatcaccaaacgacctgtatggtgaaaaagcaccaatgaactactcaagatttgtaactaagaagaacaaccaacttcttgaggaaatggattcacaaaaagcatttaaccatacatacagagtagataaattccacgaatggcaaaagtatatggatgatcaggcatacgtagttcctgtagctaacagctattcaattagtgctgtcaacaagaagcttactggttactcacttaagccatcagatggttgccctaactggtacaatgttgcttacgctaag

SEQ ID NO: 190 - protein, 585 aa, Lactobacillus acidophilus
MKKAKIFAGITLLSGVALTLAACGNSESNSNESSTAAKFSSAVPKKATKNGGTVKVAVETDTPFTGIFNDELSTSATDTGVMQYGAESLFATDDQYVFTDKGAATIKINQKAKTATINIKKNVKWSDGKPVTAKDYEYAYEIIANKATKSQRYTSSLADLVGLEEYHEGKSNTISGIEMPDGDNGRKVILHFKTMKPGMNTSGNGYIWGTAAPYHYLKDVKFKDLMSSDKIRKKPLFFGAYKLQKVVRGQSVTWVPNEYYYKGKPKLSKITASVINPNSVAQSIKSNKFDVISVINSQWQNVKGTKGVNFIAQVPLSYSYLGFKVGKWDAQRGENVMNPKSKMNNKALRQAIAYGMNVDQVYKRYTYGLSFRVPTLIPKQFGDYFDKNVKGYSYNIKKGNEILDKAGFKKKGTYRVQPNGKPLTIRLAAMTGNSTQEPIVQNYIQQWKKEGLNVKLTGGRLIEFNSFYDKIQNDDPSVDMFLGAWSLSSEPSPNDLYGEKAPMNYSRFVTKKNNQLLEEMDSQKAFNHTYRVDKFHEWQKYMDDQAYVVPVANSYSISAVNKKLTGYSLKPSDGCPNWYNVAYAK

SEQ ID NO: 191 - DNA, 1155 bp, Lactobacillus acidophilus
  CDS (1)...(1155)
  misc_feature (0)...(0): ORF 1464; transposase, IS605-TnpB family
atgattaaaacacaagtagtaaagctaaaagttaataagaccatgcaaaagcatcttgatgctttatgtgactatcggcgatactgctggaataaaggcttagaaacttggcaattaatgtatgaagctcatacactaaacaaaaaagataatcctagtcctaacgaacgcagagtccgcgatgaactagtcgcaaataaagctgactggcaatatgatttgtctgccagatgtttacaattagcgattaaagacttagctaatgcttggaagaacttctttgataagtcacaacctgattggggaatacctagttttaaatcaaagaaagctcccagacaaggctttaaaactgatagggctaagattgttaatggcaggcttcgccttgatcgtccaagaagcatttcaaaagcagattggtttgatttaaaaagctatgaagctctaaagatgaatgaagtcaaagtaataagtatcttcaaagaaaaaggagcttattatgcggcccttacctacgaagaagagcctatttcaaaaactaaaactcatcaaaagacagcagttgatgtcaatgtcggtcactttaattacacagatggcaaaattaatgttttgcctgctaaattgcaaaagctttataagcgcattaagcattatcaaagaatgctggcacgtaaaagagaagttaacggtaagttagctacaaaatcaaataattactttgcagtgagaaccaaattgcaaagagattatcgcaaggtagctaatatccaaaatgatcttttacagcagttcactactaagcttgtagataattacgaccaaatagtaattgaagacttggcagtaaagcaaatgatgatgacccatgtagcttccaaaggaatgcagagatcgctgtttagtagatttaggcagatattaacttataagtgtaattggtatggcaaagaattgatcttagctgataaaacatacccatcaactcaaagatgtgctgcgtgcggttatgtcaaaaaaggcgaggaaaagatcactttgcaaggtaacaaaaagcatggtaccaaacataatgaatatatctgttatgagtgtggctacaagaacgatcgagataaaaatgcggttttaaatcttttagctttagcaaga

SEQ ID NO: 192 - protein, 385 aa, Lactobacillus acidophilus
MIKTQVVKLKVNKTMQKHLDALCDYRRYCWNKGLETWQLMYEAHTLNKKDNPSPNERRVRDELVANKADWQYDLSARCLQLAIKDLANAWKNFFDKSQPDWGIPSFKSKKAPRQGFKTDRAKIVNGRLRLDRPRSISKADWFDLKSYEALKMNEVKVISIFKEKGAYYAALTYEEEPISKTKTHQKTAVDVNVGHFNYTDGKINVLPAKLQKLYKRIKHYQRMLARKREVNGKLATKSNNYFAVRTKLQRDYRKVANIQNDLLQQFTTKLVDNYDQIVIEDLAVKQMMMTHVASKGMQRSLFSRFRQILTYKCNWYGKELILADKTYPSTQRCAACGYVKKGEEKITLQGNKKHGTKHNEYICYECGYKNDRDKNAVLNLLALAR

SEQ ID NO: 193 - DNA, 969 bp, Lactobacillus acidophilus
  CDS (1)...(969)
  misc_feature (0)...(0): ORF 271; L-lactate dehydrogenase; L-LDH
atggcaagagttgaaaaacctcgtaaagttattttagttggtgacggtgctgtaggttctacctttgcattttcaatggtgcaacaaggtattgctgaagaattaggtatcattgatattgctaaggaacacgttgaaggtgacgcaatcgacttagcagatgctactccatggactttcccaaagaacatttacgcagctgactacgctgactgcaaggacgcagacttagtagttattactgctggtgctccacaaaagccaggtgaaactcgtcttgaccttgttaacaagaacttgaagattttatcatcaatcgttgaaccagttgttgaatcaggctttgaaggtatcttcttagtagttgctaacccagttgacatcttgactcacgcaacttggaagatttcaggcttccctaaggatcgcgttattggttcaggtacttcacttgatactggtcgtcttcaaaaggttatcggtaagatggaacacgttgacccacgttcagttaatgcatacatgcttggtgaacacggtgatactgaattcccagtatggagctacaacaatgttggtggcgtaaaggttagcgactgggttaaggctcacggtatggatgaatctaagcttgaagaaatccacaaggaagttgctgacatggcttacgacattatcaacaagaagggtgctactttctacggtatcggtacagcttcagcaatgatcgctaaggctatcttgaacgatgaacaccgtgtacttccactctcagttgcaatggatggtcaatacggtttacacgaccttcacattggtactcctgcagttgttggccgtaacggtcttgaacaaattattgaaatgcctttaaccgctgatgaacaagctaagatggaagcttctgctaagcaattaaaggaagttatggacaaagcctttgaagaaactggcgttaaggttcgtcaa

SEQ ID NO: 194 - protein, 323 aa, Lactobacillus acidophilus
MARVEKPRKVILVGDGAVGSTFAFSMVQQGIAEELGIIDIAKEHVEGDAIDLADATPWTFPKNIYAADYADCKDADLVVITAGAPQKPGETRLDLVNKNLKILSSIVEPVVESGFEGIFLVVANPVDILTHATWKISGFPKDRVIGSGTSLDTGRLQKVIGKMEHVDPRSVNAYMLGEHGDTEFPVWSYNNVGGVKVSDWVKAHGMDESKLEEIHKEVADMAYDIINKKGATFYGIGTASAMIAKAILNDEHRVLPLSVAMDGQYGLHDLHIGTPAVVGRNGLEQIIEMPLTADEQAKMEASAKQLKEVMDKAFEETGVKVRQ

SEQ ID NO: 195 - DNA, 1767 bp, Lactobacillus acidophilus
  CDS (1)...(1767)
  misc_feature (0)...(0): ORF 957; pyruvate kinase
atgaagaaaactaagattgttagtactttaggaccagcttcaaacgatattgaaactattactgctttagctaacgcaggcgcaaacgtattccgtttcaacttctcacacggtgaccatgaagaacaccgttcacgtatgaacatggttcgtgaagtggaaaagaatactggtaagcttcttggtattgctcttgatactaagggtgctgaaatcagaaccactgaacaagaaggtggcaagtttactatcaatactggtgacacaatccgtatctcaatggacgatactaagaagggtaacaaggacatgatccacgttacctacgacggcttgtacgatgatactcacgttggtggtcacgtattaatcgatgatggtttggttgaccttttgatcaaggaaaaggacgacgctaagagagaattagtttgtgaagctcaaaacactggtttaatcggttcaaagaagggtgttaacgctccaggtgttgaaattcgcctcccaggtatcactcaaaaagatactgatgacattaactttggtttgaaggaaggtatcaactttatctttgcttcattcgcacgtaaggctcaagatatcttagacatccgtaagctttgtgaagcagcaggtgctgactacgtaaagattttccctaagatcgaatcacaagaaggtatcgacaacgctgacgaaattttacaagtttctgatggtttgatggttgctcgtggtgacatgggtgttgaaattccatttatggaagttccatttgtacaaaagaacttaatcagaaaagctaacgcacttggtaagccagttattactgctactcaaatgcttgactcaatgcaagaaaacccacgtccaactcgtgctgaagtttctgacgttgctaacgctgttcttgacggtactgatgcaactatgctttcaggtgaatcagcaaacggtttgtacccagttaacgctgttaaagctatggctgaaatcgatgaacgtactgaaaagcaaatgcttaagcgtaacactttagcacttcaaagatttgaagcatacaagggctcaaacgtaactgaagctatcggtgaatcagttgtacgtactgcacaagaattaggtgttaagactatcatcgctgcaactaactcaggttacactgctcgtatgatttctaagtaccgtccaaatgctgacatcgttgcaatgaccttcgatgaaaagatccaacactcattggcagttgtttggggtgtacaaccagtattaactgacaagcctaagtcaactgatgacatgtttgaaaaggcagcagaagttgctaaggaaaagggctacgttaaggatggtgaccttgtaattatcgttgctggtgttccagttggtgattcaggtactactaacttgatgaagttacaaattatcggtaacaagcttgttcaaggtttaggtgttggtaacggttcagttatcggcaaggctgttgttgcaaactcagcagaagaagctaacagcaaggttaaggaaggcgacatcttagttgctaagactactgatccagactacaacccagctatcaagaaggcttcaggtttggttgttgaagcttcaggtttaacttcacacgcagcagttattggtttatcattaggtatcccagttgttgttggtgctactgacgctactgaaaagatttctgacggttcaactattactgttgatgctcgtcgtggtgctatttaccaaggtgaaatctcaaacctt

SEQ ID NO: 196 - protein, 589 aa, Lactobacillus acidophilus
MKKTKIVSTLGPASNDIETITALANAGANVFRFNFSHGDHEEHRSRMNMVREVEKNTGKLLGIALDTKGAEIRTTEQEGGKFTINTGDTIRISMDDTKKGNKDMIHVTYDGLYDDTHVGGHVLIDDGLVDLLIKEKDDAKRELVCEAQNTGLIGSKKGVNAPGVEIRLPGITQKDTDDINFGLKEGINFIFASFARKAQDILDIRKLCEAAGADYVKIFPKIESQEGIDNADEILQVSDGLMVARGDMGVEIPFMEVPFVQKNLIRKANALGKPVITATQMLDSMQENPRPTRAEVSDVANAVLDGTDATMLSGESANGLYPVNAVKAMAEIDERTEKQMLKRNTLALQRFEAYKGSNVTEAIGESVVRTAQELGVKTIIAATNSGYTARMISKYRPNADIVAMTFDEKIQHSLAVVWGVQPVLTDKPKSTDDMFEKAAEVAKEKGYVKDGDLVIIVAGVPVGDSGTTNLMKLQIIGNKLVQGLGVGNGSVIGKAVVANSAEEANSKVKEGDILVAKTTDPDYNPAIKKASGLVVEASGLTSHAAVIGLSLGIPVVVGATDATEKISDGSTITVDARRGAIYQGEISNL

SEQ ID NO: 197 - DNA, 897 bp, Lactobacillus acidophilus
  CDS (1)...(897)
  misc_feature (0)...(0): ORF 986; galactose mutarotase-related enzyme
atggattatacaattgaaaataatatgattaaagtcgtgatctcagatcatggtgctgaaattcaaagtgtaaaaagtgcacatactgatgaagaatttatgtggcaagcaaaccctgaaatatggggacggcatgcccctgtgctttttccaattgtaggtcgtcttaaaaatgatgaatatacctacaagggtaaaacatatcatttaggtcaacatggttttgcccgaaatgctgattttgaagtagaaaatcataccaaagaaagtattacttttttattgaaagacaatgaagaaactcgtaaagtttacccattcaagtttgagtttagagtaaactataatttaatgaacaacttacttgaagaaaactttagtgttgttaataaatctgatgaaactatgatttttggcgttggtggacatccaggcttcaatttaccaactgatcatggtgaaaataaagaagacttttattttgatatgcatccatcagtaacccgtgttagaattcctcttaaagatgctagtcttgattggaataatcgttcacttgcgcctactgatagtttaattgcattaagtgatgatttgtttaaagatgatgctttaatctatgaattacgtggaaatgataataaggtttcgcttagaacagataaaaataaatttcacgtaaatgtttggacaagggatgcaccatttgtgggtatttggtcacaatatccaaaaacggataactatgtatgtattgagccatggtggggaattgctgaccgtgatgatgctgatggtgacttagaacacaaatatggtatgaatcatttaaaaccaggaaaagaatttcaagctggttttagtatgacatatcattcaactacagatgaggtaaaa

SEQ ID NO: 198 - protein, 299 aa, Lactobacillus acidophilus
MDYTIENNMIKVVISDHGAEIQSVKSAHTDEEFMWQANPEIWGRHAPVLFPIVGRLKNDEYTYKGKTYHLGQHGFARNADFEVENHTKESITFLLKDNEETRKVYPFKFEFRVNYNLMNNLLEENFSVVNKSDETMIFGVGGHPGFNLPTDHGENKEDFYFDMHPSVTRVRIPLKDASLDWNNRSLAPTDSLIALSDDLFKDDALIYELRGNDNKVSLRTDKNKFHVNVWTRDAPFVGIWSQYPKTDNYVCIEPWWGIADRDDADGDLEHKYGMNHLKPGKEFQAGFSMTYHSTTDEVK

SEQ ID NO: 199 - DNA, 1068 bp, Lactobacillus acidophilus
  CDS (1)...(1068)
  misc_feature (0)...(0): ORF 1196; RNA polymerase sigma factor RpoD
atggtgaagcaagtcgttaaagatgttaagaaggataagtcaattactgaagatgactttactgctcgtttgattaagccttataatttacaaggtaaggctgttgatcaactagtacaagagtttgaagataatggtattagtattgttgatgaaaacggtgatccttcaaaattagctttaaagaagcaaaaagatgttgaaaaagctgaattgaaagatatgtcggctccttcaagtgtacgaatgaatgatcctgtaagaatgtacttgaaggaaattggtcgtgttccgcttcttactgctgatcaagaaattgcacttgctaagagaattgaatctggagacgaagaagcaaaacaagaattagctgaggccaaccttcgtttggtagtttctattgctaagcgttacgtaggtcgtggaatgtcatttcttgatttaattcaagaaggtaatatggggctaatgaaagccgttgataaattcgattatcgtcttggattcaagttctcaacttatgcaacttggtggattagacaggcaattactcgtgctattgctgatcaagctcgtacaattagaattcctgtgcatatggttgaaactatcaataagttgattagaattcaacgtcaattattgcaggatttaggtcgtgaaccaaccccagaagaaattggtgctgaaatgaatatgccaaccaataaagttcgtgatattcttaaaattgcccaagaaccagtttctcttgaaacacctatcggtgaagaagatgattcacatttgggtgactttatcgaagataaagacgctacaagtccagaacaacatgcttcatacgaaatgctcaaggagcaactcgaacaagtacttgaaacattaactgaccgtgaagaaaatgttttacgtttacgtttcggtctggatgatggtcgtactcgtacgcttgaagaagtgggtaaggtatttggcgtaactcgtgagcgtattcgtcagattgaagctaaggcattgcgtaaacttcgtcatccaagtcgttctaatcaattacgtgactttatggat

SEQ ID NO: 200 - protein, 356 aa, Lactobacillus acidophilus
MVKQVVKDVKKDKSITEDDFTARLIKPYNLQGKAVDQLVQEFEDNGISIVDENGDPSKLALKKQKDVEKAELKDMSAPSSVRMNDPVRMYLKEIGRVPLLTADQEIALAKRIESGDEEAKQELAEANLRLVVSIAKRYVGRGMSFLDLIQEGNMGLMKAVDKFDYRLGFKFSTYATWWIRQAITRAIADQARTIRIPVHMVETINKLIRIQRQLLQDLGREPTPEEIGAEMNMPTNKVRDILKIAQEPVSLETPIGEEDDSHLGDFIEDKDATSPEQHASYEMLKEQLEQVLETLTDREENVLRLRFGLDDGRTRTLEEVGKVFGVTRERIRQIEAKALRKLRHPSRSNQLRDFMD

SEQ ID NO: 201 - DNA, 2268 bp, Lactobacillus acidophilus
  CDS (1)...(2268)
  misc_feature (0)...(0): ORF 1870; maltose phosphorylase
atgaaacgaatttttgaaattgatccttggaaagtcattactcataaatttgatccaaaagataagagattgcaggaaagtatgactgcaatcggtaacgattacatgggaatgagaggaaactttgaagaaggttattcaggtgatagcctccaaggtacatacttagcaggagtttggttcccagataaaacggttgttggttggtggaagaatggatatccaaaatattttggtaaaacaccaaatgctccaagttttattggaattggaatcaatgtaaatggtgaaaaggtcgatttagctaaagttaaatttagcgactttgaattatcactagacatgcatcaaggtcttctttcgagaagttttatctatgaaggtaaagatgtcaaagttaagcttgaatttgaacgctttcttcacattgttcaaaaagaagctgctctaattaaagttaaagcaactgtacttgaaggccatgcaaagattgattttgactcaactttagacggcactgttgttaatgaagacagtaattatggcgatcgcttctggattccacttggtgaagataaagatgaaaaaactattcaagtaaagactaagaaaaatccatatgacgtaccacaatttacagtattgttgaaagaagcattacgtaataatggcgtagcagtaaatggagaagttactactgaagatgcaaaattgagtgaaagattctcagtagaattagacgaaggtcaaagctatgaacttgaaaaagatgtcattgttgtaactagtcgtgatgttgaagaaaaagatcaagcagccgttgctaacaacttgatgagtaaacttcaaaccaagagttttgaagataacttagcagatcatacagaagcttggaagaagcgttgggaaacaagtgatgtagaaatcagcggcgacgatgcagctcaacaaggtattcgcttcaatatttgtcaattatttatgacatattacggtgaagacaagcgcttgaatgtaggtcctaaaggctttactggtgaaaaatacggtggtgccacttattgggataccgaagcctttatcgttccaatgtatttagcagtaactaaaccaagtgttacaagagcacttcttcaatatcgtcacgatcaattgccaggtgcttaccataatgctaaagaacaaggccttccaggtgcattattcccaatggttaccttcaatggtattgaatgtcacaacgaatgggaaatcacatttgaagaaattcacagaaatgcagatattccccacgcaatagccatgtacactgattacactggcgatgacagttacgttaagaatgaaggtatggacgttttagtcggtacagcaagattctgggcagctagagttcactggtcaaagatgcgtaacaaatacgtaatgcacggtgtaacaggtcctaatgaatatgaaaataacgtaaacaacaactggtttactaacacaatggctagatggcttctcaaatatactttggaacgtttgccacttgctactaaggaagctcaagaaagagttcgtgttactgacgaagaaaaagctaaatggcaagatattgtggataacatgtacttaccagaagatgaagatcttggcattttcttgcaacaagatgatttcttagataaagatattcgtcctgttactgagattgaagatcaacgtccaattaatcaacactggtcatgggacaagattttacgttcaccatttattaagcaagccgatgttttacaaggtatttacttctttgatgatcaatacactatggatcaaaaggaaaagaacttcgatttctatgaaccattaacagttcacgaaagttcactttcaccatgtatttactcaattatggctgcagaacttggcaagaaagaaaaggcagttgaactttaccaaagaactgcacgtcttgaccttgataactataataacgacacagtagatggtttacacattacttcaatgagtggttcatggcttgcgattgttcaaggtttcgcagggatgcgttacgatcatgatcaattgaagttcaacccatttgttcctgatggttgggatcactacagctttaagattaattatcgtggtcgtttgattgaagtttatgtagatcatgatgaatgcaagattactttactttctggtgatgatcttgaagtcatggtacatgacaataaattggatttgaaggaaggtaaaactaaatgcttaaaggct

SEQ ID NO: 202 - protein, 756 aa, Lactobacillus acidophilus
MKRIFEIDPWKVITHKFDPKDKRLQESMTAIGNDYMGMRGNFEEGYSGDSLQGTYLAGVWFPDKTVVGWWKNGYPKYFGKTPNAPSFIGIGINVNGEKVDLAKVKFSDFELSLDMHQGLLSRSFIYEGKDVKVKLEFERFLHIVQKEAALIKVKATVLEGHAKIDFDSTLDGTVVNEDSNYGDRFWIPLGEDKDEKTIQVKTKKNPYDVPQFTVLLKEALRNNGVAVNGEVTTEDAKLSERFSVELDEGQSYELEKDVIVVTSRDVEEKDQAAVANNLMSKLQTKSFEDNLADHTEAWKKRWETSDVEISGDDAAQQGIRFNICQLFMTYYGEDKRLNVGPKGFTGEKYGGATYWDTEAFIVPMYLAVTKPSVTRALLQYRHDQLPGAYHNAKEQGLPGALFPMVTFNGIECHNEWEITFEEIHRNADIPHAIAMYTDYTGDDSYVKNEGMDVLVGTARFWAARVHWSKMRNKYVMHGVTGPNEYENNVNNNWFTNTMARWLLKYTLERLPLATKEAQERVRVTDEEKAKWQDIVDNMYLPEDEDLGIFLQQDDFLDKDIRPVTEIEDQRPINQHWSWDKILRSPFIKQADVLQGIYFFDDQYTMDQKEKNFDFYEPLTVHESSLSPCIYSIMAAELGKKEKAVELYQRTARLDLDNYNNDTVDGLHITSMSGSWLAIVQGFAGMRYDHDQLKFNPFVPDGWDHYSFKINYRGRLIEVYVDHDECKITLLSGDDLEVMVHDNKLDLKEGKTKCLKA

SEQ ID NO: 203 - DNA, 1656 bp, Lactobacillus acidophilus
  CDS (1)...(1656)
  misc_feature (0)...(0): ORF 466
atgagtacaaaagaacgttattctcaagatgaacttagaaaagcaaatccaatgtttagtcgcactcgtgcaactatcgaaagtgcattttatggcaataatgtgcatgaagtaactagtgtggccgaagcatataacttagctaaaaaacaatcaggcgttattgttaccgatttaccaattctccatactaaggaattaggtttgccacatgatgcaactcaattagtttacaatcacggcaagattttaggtagaacagcaagtgctcgccacttcattgataaccctaatgaagatgctgaagcgttggatgctaatttacgtgaagatatttacaaggggcataagcaaaagtacttaaaagccactgttttagttggacttgatccatcatacactgttaaggctcacatcatgatgccagaagatcaagccttcaacttactttcatacattttaaacttccaattctttgatgatgaagcagaaaaaatgtataagaaatctaagttctacaatgaacctgatatttacttctactttgatccaaacattaatgatgacgattatccaaagggctttggcgtatttgatgctccacataattgtgctgccgtatttggacttcgttacttcggtgaacttaagaagggtactttaaccttagcttgggctattgctcaccgtaatggttacactgcttgtcacggtggtgaaaagtcattccacttcgatgataaagacgataagacattcgcattttacggcttatcaggttcaggtaagtcaactttgactcatgaaatgtacgatggtaaatacgatattactgtgttgcacgatgatgccttcattatttctcgtgaagatggttcatcagttgcacttgagccttcttactttgataagacccatgactatccagcaggtcatcatgaaactaaatactacactaccattatgaactgtgatgtaactcaagatgaagatggcaagaaagttattgttactgaagatttacgcaacaacaacggtcgtgttatcaagacccgttacactagtccacatcgtgtagactttgaaaaatcaccaatcactgctttgttctggattatgaaagacggttcattacctccaattatcaagattgatgatccagtactcgcaactactatgggttgtactttagcaactaagagaactagtgctgaaaacttacctgaaggctttgacatgaacaccttagttattgaaccattcgcagacccattcagagcttacccagtttcaggtgattacaaagacttcaaggaattatttaccaagcgtggtgccagctgttacagcttaaatactgatgcatttatgggcaaggatattcctaaggaagttactaagaaattaattgaagatttggctaacggtaatattaaggacagtgacttcaaaccatttggtaacttcaagggtgtaagttacttgccaattgatggttatgaagttcaccttgatgatccagaataccaaaagactttaaagaacagaatgcaagatcgtttagattggctcgaaaattacgataaagaacatccagaaactcctattcaagatgaagctaagaagactttggaagctattattaaagaattaagt

SEQ ID NO: 204 - protein, 552 aa, Lactobacillus acidophilus
MSTKERYSQDELRKANPMFSRTRATIESAFYGNNVHEVTSVAEAYNLAKKQSGVIVTDLPILHTKELGLPHDATQLVYNHGKILGRTASARHFIDNPNEDAEALDANLREDIYKGHKQKYLKATVLVGLDPSYTVKAHIMMPEDQAFNLLSYILNFQFFDDEAEKMYKKSKFYNEPDIYFYFDPNINDDDYPKGFGVFDAPHNCAAVFGLRYFGELKKGTLTLAWAIAHRNGYTACHGGEKSFHFDDKDDKTFAFYGLSGSGKSTLTHEMYDGKYDITVLHDDAFIISREDGSSVALEPSYFDKTHDYPAGHHETKYYTTIMNCDVTQDEDGKKVIVTEDLRNNNGRVIKTRYTSPHRVDFEKSPITALFWIMKDGSLPPIIKIDDPVLATTMGCTLATKRTSAENLPEGFDMNTLVIEPFADPFRAYPVSGDYKDFKELFTKRGASCYSLNTDAFMGKDIPKEVTKKLIEDLANGNIKDSDFKPFGNFKGVSYLPIDGYEVHLDDPEYQKTLKNRMQDRLDWLENYDKEHPETPIQDEAKKTLEAIIKELS

SEQ ID NO: 205 - DNA, 855 bp, Lactobacillus acidophilus
  CDS (1)...(855)
  misc_feature (0)...(0): ORF 1027; oxidoreductase
atgaattttaactctttacaagatacttacacattaaataacggtgtgaagattccgattatcggttttggtacttggcaaacacctgatggtgaagttgctgaagaatctgttttggccgcattaaattgtggctatcgtcatattgatacagctagtgcttacggtaatgaagatagtgtaggtagagccattcaaaagagtggtattaatcgccatgaattgtttatcactaccaaattgtggaactctgatcacggatatgaaaagactaagaaagcaattgatcaaagcttgcttgacttaaagcttgattatcttgatatgtacttaattcactggccaaatccaagcagtatgcgtgatcattgggctgaaataaacgcggaaagttggagagcaatggaagaagcagttcgcgctggaaaaattcgtgcaatcggagtgtctaactttagaaaacatcacttggatgcattgatggaaactgcagaaattaagcccgttgttaaccaaattttcttgaatccaagtgatttacaatctgaagttgttactgaaaacaagaagcttgatttgctaagtgaagcttatagtccacttggaactggtggtttgttaggtaacgaggtagtaaaagaagttgctgcaaattatggcaaatctacagctcaagtattgattcgctggtcacttcaacatggctttttaccgcttccaaagtcagttcatccagaatacattaaggcaaatgcagatgtatttgattttgaaattagtccagaagatatggctaaacttgataacttgcacggtgtggctggtgtagctaacgatccagataaagttgatttt

SEQ ID NO: 206 - protein, 285 aa, Lactobacillus acidophilus
MNFNSLQDTYTLNNGVKIPIIGFGTWQTPDGEVAEESVLAALNCGYRHIDTASAYGNEDSVGRAIQKSGINRHELFITTKLWNSDHGYEKTKKAIDQSLLDLKLDYLDMYLIHWPNPSSMRDHWAEINAESWRAMEEAVRAGKIRAIGVSNFRKHHLDALMETAEIKPVVNQIFLNPSDLQSEVVTENKKLDLLSEAYSPLGTGGLLGNEVVKEVAANYGKSTAQVLIRWSLQHGFLPLPKSVHPEYIKANADVFDFEISPEDMAKLDNLHGVAGVANDPDKVDF

SEQ ID NO: 207 - DNA, 528 bp, Lactobacillus acidophilus
  CDS (1)...(528)
  misc_feature (0)...(0): ORF 8; single-stranded DNA-binding protein
atggacaaaggtatgattaatagagttgtacttgttggccgattaacacgtgatcctgaattgcgtactactggaagtggaatttcggtagctacgtttactcttgctgttgaccgtcaatttacaaatagtcagggtgagagaggcgcagactttatcagctgtgtaatctggagaaaggctgcggaaaacttctgtaactttacttcaaaaggttcattagttggtattgatggccgtattcaaaccagaagctatgacaataaagatgggcaacgagtatatgtaactgaagttgttgttgataacttctcattacttgaatcacgtaaggatcgtgaagcccgcggtcaaagtggtggatatacaccaaataatggaaatattaacaatcaacctgctaataatttccaaaataatggtggatcacaaaataatccacagattaataacaatcaaagttcttcacaagatccatttgctggatcaggtgatactattgatatttctgatgatgatcttccattc

SEQ ID NO: 208 - protein, 176 aa, Lactobacillus acidophilus
MDKGMINRVVLVGRLTRDPELRTTGSGISVATFTLAVDRQFTNSQGERGADFISCVIWRKAAENFCNFTSKGSLVGIDGRIQTRSYDNKDGQRVYVTEVVVDNFSLLESRKDREARGQSGGYTPNNGNINNQPANNFQNNGGSQNNPQINNNQSSSQDPFAGSGDTIDISDDDLPF

SEQ ID NO: 209 - DNA, 807 bp, Lactobacillus acidophilus
  CDS (1)...(807)
  misc_feature (0)...(0): ORF 455; mannose-specific PTS system component IIC
atgaacgctatacaaatgattttggtagtggccgttgcctttcttgcaggtacagaaggtatcttggatgaatggcaattccaccaaccattagttgcatgtacattaattggtttagtaacaggccatttggacttaggtgttatcttaggtggtcaattacaaatgatcgctttaggttgggcaaatattggtgccgctgttgcaccagatgccgctttagcatcagttgcttcagctattatcttggttgaaggtggtcaaggtgttaagggtatcggtactgctactggtattgctattcctttagctgttgctggtttgttcttaactatgattgtacgtactatttcaactgctatcgttcacgttatggacgcagaagctaagaagggtaactggcgtatgatcaacttgtggcaatggattgctgtatgtttgcaaggtttgagaatcgctatcccagctgctcttcttttggcaattccttcagaaactgttaaaggttggcttgcaatgatgccacaatggttatcagaaggtatgaccatcggtggtggtatggttgttgctgtaggttatgctatggttattaacatgatggcaagtaaagaagtatggccattcttcgcaatcggttttgctttagctgctatcaaggacttaactttgatcgctcttggtgctatcggtctttcaatggctttgatgtacttagctcttgaatcaaaaggtggcaacggcggttcaaacaactctggttctgctggtaccggcgatccactcggcgatatcattgatgattat

SEQ ID NO: 210 - protein, 269 aa, Lactobacillus acidophilus
MNAIQMILVVAVAFLAGTEGILDEWQFHQPLVACTLIGLVTGHLDLGVILGGQLQMIALGWANIGAAVAPDAALASVASAIILVEGGQGVKGIGTATGIAIPLAVAGLFLTMIVRTISTAIVHVMDAEAKKGNWRMINLWQWIAVCLQGLRIAIPAALLLAIPSETVKGWLAMMPQWLSEGMTIGGGMVVAVGYAMVINMMASKEVWPFFAIGFALAAIKDLTLIALGAIGLSMALMYLALESKGGNGGSNNSGSAGTGDPLGDIIDDY

SEQ ID NO: 211 - DNA, 1350 bp, Lactobacillus acidophilus
  CDS (1)...(1350)
  misc_feature (0)...(0): ORF 612; transport protein
ttgagtccagctcaaataacaactaatttagttgcaactatattaatttttattgttgcttcattctttgtcgctgcagagtttgctttagtacaaacaagaccaagtcagcttgaggatatgctggctaaaggtcaaggcaataaaaagaaattacagtgtgcgcttaatatgacgcataatttgaatgaatatttatcaactacacaagttggtactactcttgttggagtagtattagggtggttttctgctgatacttttgcggttattctggaagatctttttcatttaaccccaatgagccaatcacttattaaatcagtgagtgcaattttaggtgtaattttgttaacttatttagaagtggttttaacagaagttgtccctaaaaatattgcaattgataaaccagtaagtatgatgatggtaattgttactccgcttcatgtttttcatacattggtttatccgtttgtatggctgcttaatactagttcaaatggtattttaaagcttttaggctttgatcctgctgatgaagaaaatcaggtttattctcagtctgaaattattaagctatctcgtaatgcggttcatggtggttctcttgataaagaagacttaacttatatggaacgtgcctttgaattaaatgacaaggtagctaaggacattatgactgacagaactagattgtcggtacttgattcaactgattcaattaagtatgctttgaaaaagtatcttgaagaaggttatagtcgttttccagttgttcgtgataacaataaagacgatgtagttggatatgtttattcatacgatattgttcagcaaaatcaaattgatggttctgtacctgtaactagaattattagaacaattattaccgttccagaatcgatgccaattcaagatattttgcatttaatgatttctaagcatacaccaattgttttggtggtagatgaatacggtggaactagtggtattgtaaccgataaggatatttatgaagagctatttggttccgttaaagatgaaattgatgatgtttcagatgactacatcattaaggataaagatggaatcgttcatgtttcaggtaaaacaaccttatacgactttgaaagatttttccatactgatttaaaggcttttcaagatagtgacattatcactatcggcggatatatgatggaacattatcctaaccttcaaaaggatgaatcaattgacttagaaggttataagtttacgcttgaaagtattgaacaaggctttatgcgctggtttattgttgaacctattaaaaagaaaaaatccgatcaattaaaggatgaaaaa

SEQ ID NO: 212 - protein, 450 aa, Lactobacillus acidophilus
MSPAQITTNLVATILIFIVASFFVAAEFALVQTRPSQLEDMLAKGQGNKKKLQCALNMTHNLNEYLSTTQVGTTLVGVVLGWFSADTFAVILEDLFHLTPMSQSLIKSVSAILGVILLTYLEVVLTEVVPKNIAIDKPVSMMMVIVTPLHVFHTLVYPFVWLLNTSSNGILKLLGFDPADEENQVYSQSEIIKLSRNAVHGGSLDKEDLTYMERAFELNDKVAKDIMTDRTRLSVLDSTDSIKYALKKYLEEGYSRFPVVRDNNKDDVVGYVYSYDIVQQNQIDGSVPVTRIIRTIITVPESMPIQDILHLMISKHTPIVLVVDEYGGTSGIVTDKDIYEELFGSVKDEIDDVSDDYIIKDKDGIVHVSGKTTLYDFERFFHTDLKAFQDSDIITIGGYMMEHYPNLQKDESIDLEGYKFTLESIEQGFMRWFIVEPIKKKKSDQLKDEK

SEQ ID NO: 213 - DNA, 2091 bp, Lactobacillus acidophilus
  CDS (1)...(2091)
  misc_feature (0)...(0): ORF 289; translation elongation factor ef-G
atggctaacaagcgtgaatttccattagcaaagacacgtaatattggtattatggcccacatcgatgcgggtaagaccactactactgaacgtatcctttactacactggtaagatccacaaaattggtgaaactcacgaaggtgattcacaaatggactggatggatgaagaaaaggaacgtggtatcactattacttccgcagctactactgcacaatggaaggattacagaattaacattattgataccccaggacacgttgacttcactatcgaagtagaacgttcacttcgtgttcttgatggtgccgtaactgttcttgatgctcaagctggtgttgaaccacaaactgaaaacgtatggcgtcaagctgaaacttacggtgttcctcgtattgtttttgttaacaagatggacaagatcggtgctgactttgacaagtcagttaagtcattacatgaacgtttgaacgctaatgctcaagctgttcaaatgccaattggttcagcagacacttttgaaggtgttattgacttgatcaacatggttgctgatatttatgacgaagacaagcttggttctaagtgggatactgttccagttcctgacgaatacaaagaagaagctgaaaagcgtcgtgctgcattgattgaagctgttgctgatgttgatgacaacattatggaaaagtatcttggcggtgaagaaatttctaatgatgaattgaaggctgctatccgtaaagctactttgaacttggaattcttcccagtatacgcaggttcagcatttaagaacaagggtgttcaaatgatgcttgatggtgttattgattacttgccatcaccacttgatgttaagccttatgttgctcatgatcctaagactggtgacgaagttgaacttatggctgacgataagaagccatttgcagctcttgcatttaagattgctactgacccatttgtaggtcgtttgactttcatccgtgtttacactggttctcttgaatcaggttcatacgtattgaacgcttcaaagaactcacgtgaacgtgtaggtcgtttgcttcaaatgcacgctaactcaagaactgaaatcccagaagtattctcaggtgatattgcaggtgctattggtttgaagaacaccactactggtgactcattaactgatccagatcatccacttattttggaaagtttgcaagttccagatccagttatccaagtatcagttgaacctaaatcaaaggctgaccgtgataagatggacgttgctttacaaaagcttactgaagaagacccaactttccgtgcagaaactaatcctgaaactggtcaaactttgatttcaggtatgggtgaacttcaccttgatatcatggttgaacgtatgagacgtgaatttaacgttgaagctaagattggtgaaccacaagttgcttaccgtgaaacctttactaaggaagctaaagcacaaggtaagttcgttcgtcaatcaggtggtaagggtcaatacggtgatgtatggattgactttactcctaatgaagaaggtaagggctacgaattcgaagacgctatcgttggtggtgttgttcctcgtgaatttatcccttcagttgaccaaggtttacaagaagctatgaagaatggtgttcttgctggttacccattgatcgatgttaaggctaaactttacgatggtagttaccacgaagttgactcatcagaagctgcatttaaggttgctgcttcacttgcattgagaaatgctgcttcaaaggctggcgcagttatcttggaaccaattatgaaggttcaagtaactactccagaagaatacttaggtgatgttatgggttcaatcactgctcgtcgtggtaccatggaaggtatggaagacagagctggtgctaagattattaactcatttgttccactttcagaaatgtttggttacgcaactactttgcgttcatcaactcaaggtcgtggtacatttactatggtatttgatcactactcaccaactcctaagtcaattcaagctgatattattaagaaacgcggcggcgacgctgaa

SEQ ID NO: 214 - protein, 697 aa, Lactobacillus acidophilus
MANKREFPLAKTRNIGIMAHIDAGKTTTTERILYYTGKIHKIGETHEGDSQMDWMDEEKERGITITSAATTAQWKDYRINIIDTPGHVDFTIEVERSLRVLDGAVTVLDAQAGVEPQTENVWRQAETYGVPRIVFVNKMDKIGADFDKSVKSLHERLNANAQAVQMPIGSADTFEGVIDLINMVADIYDEDKLGSKWDTVPVPDEYKEEAEKRRAALIEAVADVDDNIMEKYLGGEEISNDELKAAIRKATLNLEFFPVYAGSAFKNKGVQMMLDGVIDYLPSPLDVKPYVAHDPKTGDEVELMADDKKPFAALAFKIATDPFVGRLTFIRVYTGSLESGSYVLNASKNSRERVGRLLQMHANSRTEIPEVFSGDIAGAIGLKNTTTGDSLTDPDHPLILESLQVPDPVIQVSVEPKSKADRDKMDVALQKLTEEDPTFRAETNPETGQTLISGMGELHLDIMVERMRREFNVEAKIGEPQVAYRETFTKEAKAQGKFVRQSGGKGQYGDVWIDFTPNEEGKGYEFEDAIVGGVVPREFIPSVDQGLQEAMKNGVLAGYPLIDVKAKLYDGSYHEVDSSEAAFKVAASLALRNAASKAGAVILEPIMKVQVTTPEEYLGDVMGSITARRGTMEGMEDRAGAKIINSFVPLSEMFGYATTLRSSTQGRGTFTMVFDHYSPTPKSIQADIIKKRGGDAE

SEQ ID NO: 215 - DNA, 960 bp, Lactobacillus acidophilus
  CDS (1)...(960)
  misc_feature (0)...(0): ORF 777; ATP synthase gamma subunit
atgcctgcatctttacttgagttaaagagaaaaattgcttcagttaaacaaactggtaaaattacagaagctatgagaatggtttctgcatcaaagttgaatcaaacagaaaatcgtgataaggattatacagtttataacgatcatgttcgtaaaactatttctcacttaattagttcacaagtggttgatagtttacgtgaaagagatatttcaattgataaaaataatatctctaagatcgattatactgatgtctttggtctaggtattactgctgatatgattcaaccacgtaagaatatcaagacaaccggattcttagttgttactggtgatcgtggattggtaggttcttacaatagttcagttattaagaatatgatgagtatttttgatgacgaacgtgcacaaggacgtgaagtgaaagttcttgctgttggatctgttggagcacaattctttaagaaaaataacgttaatgttgtttatgaaaaagatggtgtttctgatgtgcctacttttgatgaagttttaccaattgtttcaaccgctattaagatgttcttgaatggcgtatatgatcagctttatgtatgttatacgcaccatgtaaattcattgtcatctgctttccgtgttgaaaaaatgttaccaattgtcgatttagatattggtgttaaagaagctgaagcacataaagaattagaatatgatattgaaccagatgttaacagcgtattaatgaagttacttcctcaatatgctcgttcaactatctatggtgctatcttagatgcaaaaactgctgaacatgctagttcaatgacagcaatgcagagtgcaactgataacgctaatgatttagtatcaaatttaactacaaaattaaatcgtgctagacaggcacagattaccactgaaattactgaaattatcagtggtgcaaatgccttagag

SEQ ID NO: 216 - protein, 320 aa, Lactobacillus acidophilus
MPASLLELKRKIASVKQTGKITEAMRMVSASKLNQTENRDKDYTVYNDHVRKTISHLISSQVVDSLRERDISIDKNNISKIDYTDVFGLGITADMIQPRKNIKTTGFLVVTGDRGLVGSYNSSVIKNMMSIFDDERAQGREVKVLAVGSVGAQFFKKNNVNVVYEKDGVSDVPTFDEVLPIVSTAIKMFLNGVYDQLYVCYTHHVNSLSSAFRVEKMLPIVDLDIGVKEAEAHKELEYDIEPDVNSVLMKLLPQYARSTIYGAILDAKTAEHASSMTAMQSATDNANDLVSNLTTKLNRARQAQITTEITEIISGANALE

SEQ ID NO: 217 - DNA, 546 bp, Lactobacillus acidophilus
  CDS (1)...(546)
  misc_feature (0)...(0): ORF 775; ATP synthase delta subunit
atggctttaagtagagaagaagtagctgcgcgctatggtaccgctttgttcggttatgcgcaagataataaagtgttggacacagtttatgatgaaatgatggctttaaaaaaggcagcaattgctaatcctaaattcatcagtgtcctaagtgatcctattttaagtagtaaagataaaaagtctattttgactgctgttgaaaaagatttttcagatgaagtacaaggctttttgaatttattacttgaatataatcgctttgctgatttgattgatattattgatcaatttagtttactttatgataatgaaaataagattgcatctggtactgcaactactgcagtgaagctagatgatgatcaacttgagcgtttaagtgaaagctttgctaagaagtacgatttaaacgcagtgcgtcttgagaataaagttgatccaagtatattaggcggcgtgattcttcaagttaaggatcgcgtgattgatggatcagttaaaaataaactgaagaagatccgtgcgcaaataattgatgaaaat

SEQ ID NO: 218 - protein, 182 aa, Lactobacillus acidophilus
MALSREEVAARYGTALFGYAQDNKVLDTVYDEMMALKKAAIANPKFISVLSDPILSSKDKKSILTAVEKDFSDEVQGFLNLLLEYNRFADLIDIIDQFSLLYDNENKIASGTATTAVKLDDDQLERLSESFAKKYDLNAVRLENKVDPSILGGVILQVKDRVIDGSVKNKLKKIRAQIIDEN

SEQ ID NO: 219 - DNA, 771 bp, Lactobacillus acidophilus
  CDS (1)...(771)
  misc_feature (0)...(0): ORF 152; ABC transporter (alkylphosphonate), ATP-binding protein
atggcagataagccaatgatccaattaaaagatgtttctaagatttatgacaatggaactgtcggcttaaaagacatcaacttaaaaattaataaaggcgaattcgtagtagtagttggtttgtctggtgcggggaagtcaactttacttcgttcaattaatcgtctacatgatatttcttcaggcgatattttaattgatggtaagtcaattacaaacgctaagggtaaaaatttgcgcgaattacgtcgtgatattggaatgattttccaaaactttaacttagttaagcgctctagcgtattacgtaacgttttagtaggtagagttgcttattacccaacttggaagactacttttaacttgtttaccaaagaagataagcaaaaagcttatgaagcacttcaaaaagttgatttggcagataaggtatacgcacgtgcagatgaattatcaggaggtcaacaacaacgtgtggccattgctcgtgtgttaatgcaaaatcctaagatcattttggctgatgaaccaacagcttcacttgatcctcagacttcagttagagttatgaatgacttgaagatgcttaatgaaaaatatggcatgactgtagttgctaacttgcacagtatcgaacttgctcaacaatttggtaagcgagtaatcggtattcgtgcaggacaagtagtttacgatggtaagatggaagacactcctaagtcagtatttaccgatatttataacggtggcgacggtaatgagggggcagaa

SEQ ID NO: 220 - protein, 257 aa, Lactobacillus acidophilus
MADKPMIQLKDVSKIYDNGTVGLKDINLKINKGEFVVVVGLSGAGKSTLLRSINRLHDISSGDILIDGKSITNAKGKNLRELRRDIGMIFQNFNLVKRSSVLRNVLVGRVAYYPTWKTTFNLFTKEDKQKAYEALQKVDLADKVYARADELSGGQQQRVAIARVLMQNPKIILADEPTASLDPQTSVRVMNDLKMLNEKYGMTVVANLHSIELAQQFGKRVIGIRAGQVVYDGKMEDTPKSVFTDIYNGGDGNEGAE

SEQ ID NO: 221 - DNA, 1917 bp, Lactobacillus acidophilus
  CDS (1)...(1917)
  misc_feature (0)...(0): ORF 1463; lactose permease
atggcaaatggtcataaaacttcggggaaacaaataatttcctatgcatcattctgtctgggcaacttaggacacgcagccttttatggtgtaatgagcacatactttattatttttattactagtggaatgtttagtggattagagcaatcggtagctgacaaactaatcggtctaatcaccggattaatggttttaataagaatcgtagaactagtaattgatccaattttaggcaatattgttgataatacaaaaacaaaatggggtaaatttaaaccatggatattcattggaaccatggttagtgcagtattattattaatcttgtttactgggattttcggtttagcacaaagtaattggattctttttgcaatccttttcgtaattatctatattggatttgatgtcttctattcattatctgatgtttcatattgggggatggtaccggctttaagtgaagattcacatgagcgtggtatttatacttctctaggtgctttttcaggtgctattggctggaatggattagcaattatcgtagttcctttagtaactggagttacttatgcagtgactggtaaaaatgaagagggagctcctggctggctcgcttttgcggccgtaatttcagctttggcgattatttgtgccatcattgtatgtttcggtactaaagaaaagcataacttaattagaaattcggctaagcaaaaaactactttacgtcaagttttcagtgctatttttcataatgatcaaatactttggccaagtctagcttacttagtattttcacttgccaatacaattaccaacggtgttttattctatctatataaattcgtaattggtaaaccaggagaattctgggtagtagggcttatagctactattattggattttgcgttagtccaatgtttccaattttaaacaaatatattccaagaaaatggctattcattgcaggtcaaacttgtatgatttgtgcatatcttttattcattttctgtcgtgataatgttgtattgatggacttaggtttgatcctgttcaacattaactttgcacaattagttactgttttgactttaactgatgccattgaatatggccaacttaagagtggtcaaagaaatgaagccgttgttttggctgtccgtccgatgattgataaatttactggcgctgtttctaacgctttggttggttatgtagctattgctgcaggaatgacgggaacggctacagctgcggatatgactgcacatgatattagcacttttaatactatggctttatatattccattagttttacctgcaatttcaattgtggtattcatgactaaagtaaacttgagtgaaaagaaacacgcacaggttgttgaagaattaaaggataaacttgctgaaggaaagcttgaaaaagccgatacggaagcagctcgtccgaaagaagtaacaatctatgctccagcagatggtaaattaatgaatatgtcttcggtaattgatgaggacggtcgtccttttccaggtaagggatttgcaattaagccaagtacaggtaaaatttatgcaccatttgatggtgagattaaatttacttttggtacaaagcatgcatttgaaattatttcaaatgatggcttacaagtaatcgttcatgttggtctgggaacagttaacttgcgtggacaaggatttgaaacttattatgacgatgggcaacacgttaagaagggtgacttgttactagaatttgatcgagacttagcactgaataatggatataaagacacaatagttacgttctatacgcagcctcgtcgaattcaggagactagtgaaattcaagccggtacaactgttgagcacggtgaaaaagttgtagaagttaaatttaga

SEQ ID NO: 222 - protein, 639 aa, Lactobacillus acidophilus
MANGHKTSGKQIISYASFCLGNLGHAAFYGVMSTYFIIFITSGMFSGLEQSVADKLIGLITGLMVLIRIVELVIDPILGNIVDNTKTKWGKFKPWIFIGTMVSAVLLLILFTGIFGLAQSNWILFAILFVIIYIGFDVFYSLSDVSYWGMVPALSEDSHERGIYTSLGAFSGAIGWNGLAIIVVPLVTGVTYAVTGKNEEGAPGWLAFAAVISALAIICAIIVCFGTKEKHNLIRNSAKQKTTLRQVFSAIFHNDQILWPSLAYLVFSLANTITNGVLFYLYKFVIGKPGEFWVVGLIATIIGFCVSPMFPILNKYIPRKWLFIAGQTCMICAYLLFIFCRDNVVLMDLGLILFNINFAQLVTVLTLTDAIEYGQLKSGQRNEAVVLAVRPMIDKFTGAVSNALVGYVAIAAGMTGTATAADMTAHDISTFNTMALYIPLVLPAISIVVFMTKVNLSEKKHAQVVEELKDKLAEGKLEKADTEAARPKEVTIYAPADGKLMNMSSVIDEDGRPFPGKGFAIKPSTGKIYAPFDGEIKFTFGTKHAFEIISNDGLQVIVHVGLGTVNLRGQGFETYYDDGQHVKKGDLLLEFDRDLALNNGYKDTIVTFYTQPRRIQETSEIQAGTTVEHGEKVVEVKFR

SEQ ID NO: 223 - DNA, 690 bp, Lactobacillus acidophilus
  CDS (1)...(690)
  misc_feature (0)...(0): ORF 185; phosphoglycerate mutase
atgtcaaaattagttttaatccgtcacggtcaaagtgaatggaacctttcaaaccaatttactggttgggttgacgttaacctttcagaaaaaggtgttgaagaagctaagaaggctggtcgtttaatcaaggaacacggtcttgaatttgatcaagcttacacttcattattaactcgtgctatcaagactttgcactacgcattggaagaaagtgaccaactttggattccagaaactaagacttggagacttaacgaacgtcactacggtgctcttcaaggcttgaacaagaaggctactgctgaaaagtacggtgatgaacaagttcacatttggcgtcgttcatacgatgttttgccaccagctattgacgatgacaacgaatttagtcaagcacatgaccgtcgttacgcaaacttggatccacacatcgttcctaaggcagaaaacttacacgtaactttggatcgtgtaatgccattctgggaagataacattgctccagacttacttgacggtaagaacgtaattattgctgcacacggtaactcacttcgtgctttgactaagtacattgaaaacatttctgacgatgacatcatggacctcgaaatgaagactggtgaaccagttgtttacactttcgacgaaaacttggatgttgttaacaaggaaaagttggacgac

SEQ ID NO: 224 - protein, 230 aa, Lactobacillus acidophilus
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKATAEKYGDEQVHIWRRSYDVLPPAIDDDNEFSQAHDRRYANLDPHIVPKAENLHVTLDRVMPFWEDNIAPDLLDGKNVIIAAHGNSLRALTKYIENISDDDIMDLEMKTGEPVVYTFDENLDVVNKEKLDD

SEQ ID NO: 225 - DNA, 1047 bp, Lactobacillus acidophilus
  CDS (1)...(1047)
  misc_feature (0)...(0): ORF 55; D-lactate dehydrogenase
atggtcatactaataaattttacggaggttaaatttatgacaaagatttttgcttacgctattcgtaaagacgaagaaccattcttaaacgaatggaaggaagctcacaaagatatcgatgttgattacactgataaacttttgactcctgaaactgcaaagcttgctgaaggtgcagacggtgttgttgtttaccaacaattagactacactcctgaaacccttcaagcattggcagatgctggcgtaactaagatgtcattacgtaacgttggtgtcgataacatcgacatggacaaggccaaagaattaggctttgaaatcactaatgttcctgtttactcaccagacgctattgctgaacatgctgctattcaagctgcacgtgtattacgtcaagacaagcgcatggacgaaaagatggctaaacgtgatttacgttgggcaccaactatcggccgtgaagttcgtgaccaagttgtcggtgttgttggtactggtcacattggtcaagtatttatgaagattatggaaggctttggcgcaaaagttattgcttacgatatcttcaagaaccctgaacttgaaaagaagggttactacgttgattcacttgatgacttgtacaagcaagctgatgtaatttcacttcacgtaccagacgttccagctaacgtacacatgattaacgatgaatcaatcgccaaaatgaaggatggcgttgtaatcgtaaactgctcacgtggtccacttgttgacactgatgcagtaattcgtggtttagactcaggcaagatcttcggcttcgttatggatacttacgaaggcgaagttggtgtatttaacaaggactgggaaggtaaagaattcccagacgaacgcttggcagacttaattgatcgtccaaacgtattggtaaccccacacactgccttctacactactcacgctgtacgtaacatggttgttaaggcatttgacaacaacttggaattaatcaagggcgaaaaaccagattctccagttgctttggacaagaacaagttc

SEQ ID NO: 226 - protein, 349 aa, Lactobacillus acidophilus
MVILINFTEVKFMTKIFAYAIRKDEEPFLNEWKEAHKDIDVDYTDKLLTPETAKLAEGADGVVVYQQLDYTPETLQALADAGVTKMSLRNVGVDNIDMDKAKELGFEITNVPVYSPDAIAEHAAIQAARVLRQDKRMDEKMAKRDLRWAPTIGREVRDQVVGVVGTGHIGQVFMKIMEGFGAKVIAYDIFKNPELEKKGYYVDSLDDLYKQADVISLHVPDVPANVHMINDESIAKMKDGVVIVNCSRGPLVDTDAVIRGLDSGKIFGFVMDTYEGEVGVFNKDWEGKEFPDERLADLIDRPNVLVTPHTAFYTTHAVRNMVVKAFDNNLELIKGEKPDSPVALDKNKF

SEQ ID NO: 227 - DNA, 507 bp, Lactobacillus acidophilus
  CDS (1)...(507)
  misc_feature (0)...(0): ORF 774; H+-transporting ATP synthase chain b
atgactattcaaacattgtttgccgcctcacatcatatttacctaggtaatgctatttggtatttactttgttttgccatcttgatgctattgattaagcattatgcctggggtccagtatcagacatgatggaaaaacggcgacaaaaaattattagtgacttggattcagctgcaagtgatcgtaaaaaagctgaaacgcttgctaatgagcgtgaagctgccttgaagaactcaagacaagaagcaacacagattctctctgacgctaaaactaatgcgcaaaatacaagcaaagaaattgtagctagtgcaaatgaagatgctgcagctattcgtaaaaaagcaaatgaagaagctgctaaagctaaatcagatgctttggatgctgcacgtgatcaagttgctgatatttctgtagcaattgctgaaaaagttattgccaagaatttatctgctgaagaccaaaaggatttagtcgaccaatttattaaggggttggatgat

SEQ ID NO: 228 - protein, 169 aa, Lactobacillus acidophilus
MTIQTLFAASHHIYLGNAIWYLLCFAILMLLIKHYAWGPVSDMMEKRRQKIISDLDSAASDRKKAETLANEREAALKNSRQEATQILSDAKTNAQNTSKEIVASANEDAAAIRKKANEEAAKAKSDALDAARDQVADISVAIAEKVIAKNLSAEDQKDLVDQFIKGLDD

SEQ ID NO: 229 - DNA, 996 bp, Lactobacillus acidophilus
  CDS (1)...(996)
  misc_feature (0)...(0): ORF 1468; beta-galactosidase small subunit
ttgcagatagaacaccaaagccagcaatgcaggaggttagatattactatggcttacacaaataatttacaaatcatctatggtgatgccactttaggaatcactggtaaaaacttccattatcttttcagctacgaacgaggtgggttagaatcactcaacatcaataacaaagaatggttatatcgtgtgccgacccctactttctggcgagctactaccgataatgatcgaggtaatggctttaatttaaaggcatctcaatggctcggtgctgatatgtttactaaatgcactaaaatcgaattaaaggtagatgaccgacaattcgacgaacttccaattgctccaattaataatcaattcagtaatcatgaatatgctgaccatgttcaaattgcgttttggtatcaaactctaactaatccagcaactgacgttaaaatcatttataatattgataatactggttgtattaatatagtcatgcattattttggtaaaaaaggattgccaccattaccagtgattggaatgcgtttcatcatgccaactgctgcaactggctttgactacgaaggactttcgggggaaacttatcctgaccgaatggctggtgcaaaagaaggaaaattccatgttgatggcttaccagtaactaaatatttagtaccacaagaaaacgggatgcatatgcaaactaaggcactcaaaatcactcgttcttctactttaaataatgctgatcaagaaagtgaatttagtctaaagcttaagcaagataaacaaccgtttaattttagttgtttaccctacactgctgaagaattagaaaatgctactcatctcgaggaattaccacttgctcgcagaactgtgttagttattgctggagctgtgcgcggcgttggtggtatcgacagctggggtgctgatgttgaaaagcaatatcacattaatcctgaaaaagactacgaattttctttcaatcttaat

SEQ ID NO: 230 - protein, 332 aa, Lactobacillus acidophilus
MQIEHQSQQCRRLDITMAYTNNLQIIYGDATLGITGKNFHYLFSYERGGLESLNINNKEWLYRVPTPTFWRATTDNDRGNGFNLKASQWLGADMFTKCTKIELKVDDRQFDELPIAPINNQFSNHEYADHVQIAFWYQTLTNPATDVKIIYNIDNTGCINIVMHYFGKKGLPPLPVIGMRFIMPTAATGFDYEGLSGETYPDRMAGAKEGKFHVDGLPVTKYLVPQENGMHMQTKALKITRSSTLNNADQESEFSLKLKQDKQPFNFSCLPYTAEELENATHLEELPLARRTVLVIAGAVRGVGGIDSWGADVEKQYHINPEKDYEFSFNLN

SEQ ID NO: 231 - DNA, 1161 bp, Lactobacillus acidophilus
  CDS (1)...(1161)
  misc_feature (0)...(0): ORF 1459; galactokinase
atgaataaagaagaacttctcactgaatacgaaaaaacatttaatgaaaacggccaagacgtctttttctcacctggaagaattaatgtaattggtgaacatactgactataatggtggtcatgtttttccagctgcaattagcttgggtgtctatggtgtatatggaccaagagatgatacgaaggtccgcttatattctggcgatgttgacggtgatgttgttgagtttgatatcaatgatacaactgttgaaaaagatgaccgcttctgggcaaattacttcaagggaatgatcacttacttacgtgaaaagtacgacaacatcaaccacggctttaacttatatatcaaagctaacttgccatctggttctggtctttcgtcaagtgcagctattgaaatgctcatgggtatcattcttaaagacgaatttaacctcgatgttgatcgcattgcattagctaaaatgggacaaagaactgaaaatgaatttgtaggcttgaactcaggtatcatggatcaattcgcctgcattatgggtaaaaaggatagtgcaattttccttgactgtaatactttggaatatgaatataagccacttgccttaggcgattatgagatcatcattatggccactaacaagccacatactttagctgattccgcatataatgatcgtgttcgtgaatgtcatgatgcacttgaaaaattacaacaaaagcttgatgttaagtcattgggtgaacttgataatgatactttagatgaatattcttatcttattaatgatgaaactgaattaaaacgcgctcgtcatgctgtaagtgaaaaccaaagaactttgcgtgctactaaggctatgcaagatggtgatttagaaaaacttggtcgcttgatcgatgcttctcacgtctcacttcattatgactacgaggtaactggtgatgaacttgacactttagctgaagcttcatggaagcagccaggagttttaggcgcaagaatgattggtggtggcttcggtggtagtgcaatcgctatcgtaaaaaagagtgaagctgaaaactttaagcagaatgtcggtaaaatttatcgtgacaagattggttatgatgctagtttttatgatgctgaaattgttgatggtactaagaaaatc

SEQ ID NO: 232 - protein, 387 aa, Lactobacillus acidophilus
MNKEELLTEYEKTFNENGQDVFFSPGRINVIGEHTDYNGGHVFPAAISLGVYGVYGPRDDTKVRLYSGDVDGDVVEFDINDTTVEKDDRFWANYFKGMITYLREKYDNINHGFNLYIKANLPSGSGLSSSAAIEMLMGIILKDEFNLDVDRIALAKMGQRTENEFVGLNSGIMDQFACIMGKKDSAIFLDCNTLEYEYKPLALGDYEIIIMATNKPHTLADSAYNDRVRECHDALEKLQQKLDVKSLGELDNDTLDEYSYLINDETELKRARHAVSENQRTLRATKAMQDGDLEKLGRLIDASHVSLHYDYEVTGDELDTLAEASWKQPGVLGARMIGGGFGGSAIAIVKKSEAENFKQNVGKIYRDKIGYDASFYDAEIVDGTKKI

SEQ ID NO: 233 - DNA, 675 bp, Lactobacillus acidophilus
  CDS (1)...(675)
  misc_feature (0)...(0): ORF 1388
ttgataatcggtttaataaggagaataaaaatgactaaaattgctgtattaggtgctagtggacaaattgctaagttggcagaagaatttttcttaaaggatgcagataacgaattgatcttgttcttgcgtcatcctaacaagttagacaagtctgaaatcgatgaaaatcgtgaaaagattattgtgggggatgcaagtaaagtagatgaagttgctgcggctattaagggcgtcgaccttgtatatgctaacttagctggtggtaacattgaagatcaagctaaagcagtggtaaaggcgatggatcgagatggcattaagcgtcttatctggatttcttcattaggtgtatatgatgaagttcctggtaagtttggtgaatggaacaagaatatcttaggttcatatctcaccacttatcgtgctgccgccgatgtgattactgctagtgatttggactacacaattattcgtcctgcatggcttactaataaagatgaagtagattatgaagttactcgtggcgcacatactgcatttaagggtactgaggtatcacgtaagagtgtagcaagttacatcaatgacttggttaaagatccaagtaaggatgcccgtggtaacattggacttaacaagccaaatactgatggcgataaaccagcttggtat

SEQ ID NO: 234 - protein, 225 aa, Lactobacillus acidophilus
MIIGLIRRIKMTKIAVLGASGQIAKLAEEFFLKDADNELILFLRHPNKLDKSEIDENREKIIVGDASKVDEVAAAIKGVDLVYANLAGGNIEDQAKAVVKAMDRDGIKRLIWISSLGVYDEVPGKFGEWNKNILGSYLTTYRAAADVITASDLDYTIIRPAWLTNKDEVDYEVTRGAHTAFKGTEVSRKSVASYINDLVKDPSKDARGNIGLNKPNTDGDKPAWY

SEQ ID NO: 235 - DNA, 1293 bp, Lactobacillus acidophilus
  CDS (1)...(1293)
  misc_feature (0)...(0): ORF 311; protein translocase secY
atgttttcgaccttgaagaacgcctttaaggataaagaaattagaaataaaatttatttcactctttttattcttttaatatacaggattggtgctaatattaccgttcctggtgttaatgcaaaggcgatcacacaggttgctcaaactggattagttccaatgctggatactgtatccggtggtggactagataactattcaatattttcattgggtgtttccccgtatattacggcgcagatcgtaattcaacttttacaaatggatattgttccgacattagtcgaatgggggaagcaaggggaagttggtagacgtaaaaccaatcaagtaacaaggtatttaactttagttgttgcttttgttcaaagtattggtattacgttaggattcaacgccttaactcaaatggggttagttaaaaatcaaacaccccagacttatgtagaaattgccattattatgactgctggaacgatgttattaacatggttaggtgatgaaatcactgataagggtcttggaaatggtgtatcagtaattatttttgctggtattattgcaagattaccaagtggcttatggcaaatttacaaagaagaaattattaacaatagtgccagtgatcgttggcaaggtattttgttcttcatcgcggttatagttgcaatccttatcgtaactcaattagttacgtgggttgaacaggctgatcgtcgcattcccattcaatatacaagaagagcgacgattagtggttctgaaagttttctaccattaaaagttaatgtatctggggttattccagttatttttgccagttcatttattattacgccggcaacaattttaatggcctttcaaagaacccaaggcgatcaacaatggtttaaagtattgaatcaaatctttagtttacaaactactcctggtgttatcatctacactcttttaattattttatttactttcttctacgcttttgttcaggttaaccctgagaagctagcagaaaacttacaaaaacagggtgcttatattcctagcgtttggccaggtaaagatacacagaattatatttcaaagatgttgatcaagttatcaactgtaggttcaatatttttaggtttagttgctctattgcctcaattggctactaacttttggaatctcccaagttccattggtttaggaggaacaagtcttttaattgtgattggggttgttcttgagttatctcgtcaaattaacggcttgttaatgaagagagaatatgttggattcatcaga

SEQ ID NO: 236 - protein, 431 aa, Lactobacillus acidophilus
MFSTLKNAFKDKEIRNKIYFTLFILLIYRIGANITVPGVNAKAITQVAQTGLVPMLDTVSGGGLDNYSIFSLGVSPYITAQIVIQLLQMDIVPTLVEWGKQGEVGRRKTNQVTRYLTLVVAFVQSIGITLGFNALTQMGLVKNQTPQTYVEIAIIMTAGTMLLTWLGDEITDKGLGNGVSVIIFAGIIARLPSGLWQIYKEEIINNSASDRWQGILFFIAVIVAILIVTQLVTWVEQADRRIPIQYTRRATISGSESFLPLKVNVSGVIPVIFASSFIITPATILMAFQRTQGDQQWFKVLNQIFSLQTTPGVIIYTLLIILFTFFYAFVQVNPEKLAENLQKQGAYIPSVWPGKDTQNYISKMLIKLSTVGSIFLGLVALLPQLATNFWNLPSSIGLGGTSLLIVIGVVLELSRQINGLLMKREYVGFIR

SEQ ID NO: 237 - DNA, 1368 bp, Lactobacillus acidophilus
  CDS (1)...(1368)
  misc_feature (0)...(0): ORF 1115; amino acid permease
atgaaaaattcaaatggaaaacccaagaaattatccttcatttccatatatttcttaggtattaatgcagtaattggttcaggtacttttctacttcctgcgcaaatataccatgatatgaatctaatggctatatttgttttactatgtactgcggtaactgtgtcaatgattgctttatgttatgctgatttatccagcagatttaaaggttcaggagctgcttggttatatgcataccacgcttttggaaggtttacaggctatgaactaggtatatttacatggttcctaggttgctgtacattgggtgccgaaatcgttgcacttttaacgacactaaagagtttttggccagcactaaataattcaatagtatattatgcaattgctttagggttacttttattattctcaataatcaacttttttggtcgttctttagtaaaagtggtaaataatatctcagcagctgccaaaatggtcactttgattgtatttattgtcgtaggtgcattctttattcgccaagccaatttttcacctgttattccagcagctgcaaccaaaggagcagttccatttttacaacactttggagctgcctttacgccgatattttatttatttacaggattttcatttattccaattgcggctcgtcaaatgaataacccagaaaaaaatattcctagagttctaatagcagttatggttagtgtaactattctagattgtctaatgatgattgtagctattggtcttgttggtgataaattaggtacatactctacacctttggctagcgcattagagcatggtgttggtaaatggggatattcatttattattgttggtatgcttatctctatatttggtgttgcattttctgcatcatttaatgcaccatctttaatagcttcactttcaaatgaacataagcttttaccagcatgggtaggcaaaaagaataaacatgatgctccatgggtaggaattataatgaccgctgttttaacagggatatttgtaactcaatcatatctttttttagtatcatgtactgttctggcttcatttattcaatacgtaccatctattttagctgtaattaaatttaagcacagtaatgaatttcctaatcatggattttcattaccgggaaaatatactattccaactattgcattaatcgtttcatgctatatggtaactaattttactccgttaactttgttagtaggagtggtagttgcagcaattggtgctgtattatacttctttattgatagaagcccagctatgaagaaaaaagaaaaaatgcatcaggaatttttgaatgaattaagacataacgaaattaaattt

SEQ ID NO: 238 - protein, 456 aa, Lactobacillus acidophilus
MKNSNGKPKKLSFISIYFLGINAVIGSGTFLLPAQIYHDMNLMAIFVLLCTAVTVSMIALCYADLSSRFKGSGAAWLYAYHAFGRFTGYELGIFTWFLGCCTLGAEIVALLTTLKSFWPALNNSIVYYAIALGLLLLFSIINFFGRSLVKVVNNISAAAKMVTLIVFIVVGAFFIRQANFSPVIPAAATKGAVPFLQHFGAAFTPIFYLFTGFSFIPIAARQMNNPEKNIPRVLIAVMVSVTILDCLMMIVAIGLVGDKLGTYSTPLASALEHGVGKWGYSFIIVGMLISIFGVAFSASFNAPSLIASLSNEHKLLPAWVGKKNKHDAPWVGIIMTAVLTGIFVTQSYLFLVSCTVLASFIQYVPSILAVIKFKHSNEFPNHGFSLPGKYTIPTIALIVSCYMVTNFTPLTLLVGVVVAAIGAVLYFFIDRSPAMKKKEKMHQEFLNELRHNEIKF

SEQ ID NO: 239 - DNA, 705 bp, Lactobacillus acidophilus
  CDS (1)...(705)
  misc_feature (0)...(0): ORF 270
atgcttattaaatctttggttattaagaaagattacttaacaacagttaatgaaagagccacattagcagaagcactaaaaatcttagaagactcaggttatagatgtgtgccaattgttgatgatactggtaccatcttccgtggtaacatttataaaatgcacatctaccgtcataagtcacaaggtggcgatatgaatttacctgtaacttacttactcaagaatgctactaaaacaattaaggttaactcaccatttttcaaagttttcttcaacattaaagacttgccatacattgctgttcttgatgaagaaaatcatttttatggcattttgacccactcaagattgcttgacatgttatctgatgcttgggatattaaaaatggttcatatgttttaactgtcttgtcagataatacccgggataatttaattaaaatgtccaaaatcgtttcaaagcacactaacatgtctagtgttatgacacttgatgctgcagctggtgagcttgaaggtgactttgttagaagaactttattcactttacctgcaggcgtttctgatattaccatgaagacgatcgttaataaattgcaaaagaaaggcttcgtagtttctgaaattgaagacttacaagctgggatgacaattatgagcgatgaaaatcctggtgtattcatcgaacgaccagaacatgac

SEQ ID NO: 240 - protein, 235 aa, Lactobacillus acidophilus
MLIKSLVIKKDYLTTVNERATLAEALKILEDSGYRCVPIVDDTGTIFRGNIYKMHIYRHKSQGGDMNLPVTYLLKNATKTIKVNSPFFKVFFNIKDLPYIAVLDEENHFYGILTHSRLLDMLSDAWDIKNGSYVLTVLSDNTRDNLIKMSKIVSKHTNMSSVMTLDAAAGELEGDFVRRTLFTLPAGVSDITMKTIVNKLQKKGFVVSEIEDLQAGMTIMSDENPGVFIERPEHD

SEQ ID NO: 241 - DNA, 231 bp, Lactobacillus acidophilus
  CDS (1)...(231)
  misc_feature (0)...(0): ORF 773; H+-transporting ATP synthase C chain
atgacttttatgtcagaagcttttaaatatctcgctgcagccattgcagctggattagctgctttagctgcatcattaggtaacggtaaagttatctcaaagacaattgaaggtatggctcgtcaacctgaaagtgcgggtaatttaagagcaacaatgttcattggtgttggtttgatcgaagccgttcctattttggctattgttgttgccttcttgattcttttcctt

SEQ ID NO: 242 - protein, 77 aa, Lactobacillus acidophilus
MTFMSEAFKYLAAAIAAGLAALAASLGNGKVISKTIEGMARQPESAGNLRATMFIGVGLIEAVPILAIVVAFLILFL

SEQ ID NO: 243 - DNA, 1884 bp, Lactobacillus acidophilus
  CDS (1)...(1884)
  misc_feature (0)...(0): ORF 1467; beta-galactosidase large subunit (lactase)
atgcaagcaaacataaaatggcttgatgaccctgaaatttttagagtcaatcaattgccagctcatagcgatcatcctttttttaagaattatcgtgaatggcaaaataatcacagtagttttaagcaaagtttaaatggaatgtggcaattcaaattttctaaagatccccaaagccgtcccgttgacttctacaaaaaggactttaacacttcatctttcaccacaatcccagttcctagtgaaattgaattaaacaattttgcacaaaatcaatacattaatactctttatccctgggaagggaaaattttccgtcgtcctgcttacgcattaaataaatctgatgctgaagaaggttctttcagtgaaggtaaagataacaccgtcggttcatacataaaacattttgacctaaatccagaattaagggatcatgatattcatatcgtattcgaaggtgccgaacgagccatgtatgtttggttaaacggccatttcattggatatgccgaagatagctttactccttcggaatttgatttaaccaagtatattaaagaaaaagacaatatcttagctgttgaagtttttaaacacagtacggcttcttggcttgaagatcaagacatgttcagattttctggtctatttagatccgttgaattactagcatttcctgaaacacatttagttgatttggatcttaaacctactgtttgtgacaactatcaagatggtattttcaatgctgaattaaaatttactggttcactcaatggtcatgttcacttatccgtagaagacgtcaacggctcagctattttagaacaagatgtcccacttgactccgaagttgaatttactagctcaactttggaaaatattcatttatgggacaatcatcatccttacttgtatcagttattgattgaagtccatgatgaaaatggtcacctagttgaattaattccttaccaatttggctttagacgaattgaaattaatcaagacaaggtaattttactcaacggcaaatgcctaattattaacggagttaatcgccatgaatggaatgccaaaactggccgtagcattaccctgaacgatatggaaaaagatatcgatactttcaaagaaaacaatatcaacgctgttagaacttgccattatcccaaccaaatcccatggtattatctttgcgatcaaaacggcatttatatgatggcagaaaacaacctggaatctcatggtacctggcaaaagatggggcaagttgaaccatctgataatgtacctggttctgttcctgaatggcgtgaagcagtaatcgatcgcgcccgcaataattatgagactttcaaaaatcatacatccatcctattctggtcattaggaaacgaatcttatgccggtagtaatatcgttgcaatgaacgaattttacaaagaacatgattcttctcgtctagttcactacgaaggtgtcgttcatagaccagaattaaaagatcaaatttctgatattgaaagccatatgtatctaccacctaaagaggtcgcagaatacttaagaaataacccacaaaaaccatttatggagtgtgaatacatgcatgacatgggtaattctgatggtggtatgggcagctatattaaattaattgatgaatacccacaatatgtaggaggatttatttgggactttattgatcaagcgctcttagtctacgatcctatcagtaaacaaaacgttctccgttatggtggcgattttgatgatcgtcactcagactatgaattttctggtgatgggttaatgtttgcagatagaacaccaaagccagcaatgcaggaggttagatattactatggcttacacaaa

SEQ ID NO: 244 - protein, 628 aa, Lactobacillus acidophilus
MQANIKWLDDPEIFRVNQLPAHSDHPFFKNYREWQNNHSSFKQSLNGMWQFKFSKDPQSRPVDFYKKDFNTSSFTTIPVPSEIELNNFAQNQYINTLYPWEGKIFRRPAYALNKSDAEEGSFSEGKDNTVGSYIKHFDLNPELRDHDIHIVFEGAERAMYVWLNGHFIGYAEDSFTPSEFDLTKYIKEKDNILAVEVFKHSTASWLEDQDMFRFSGLFRSVELLAFPETHLVDLDLKPTVCDNYQDGIFNAELKFTGSLNGHVHLSVEDVNGSAILEQDVPLDSEVEFTSSTLENIHLWDNHHPYLYQLLIEVHDENGHLVELIPYQFGFRRIEINQDKVILLNGKCLIINGVNRHEWNAKTGRSITLNDMEKDIDTFKENNINAVRTCHYPNQIPWYYLCDQNGIYMMAENNLESHGTWQKMGQVEPSDNVPGSVPEWREAVIDRARNNYETFKNHTSILFWSLGNESYAGSNIVAMNEFYKEHDSSRLVHYEGVVHRPELKDQISDIESHMYLPPKEVAEYLRNNPQKPFMECEYMHDMGNSDGGMGSYIKLIDEYPQYVGGFIWDFIDQALLVYDPISKQNVLRYGGDFDDRHSDYEFSGDGLMFADRTPKPAMQEVRYYYGLHK

SEQ ID NO: 245 - DNA, 546 bp, Lactobacillus acidophilus
  CDS (1)...(546)
  misc_feature (0)...(0): ORF 1833; oxidoreductase
atgaatttattagtaattgttggtacaaatgctccattttcatataatcgttttttagcaaaatttattgctaagcgttatggtgataaagccgatattgaagtaaaagagattgaccaaattaaaccattttgtagatctgaagaaccagatgaaattactaaacaatggattgaagatattaaaaattctgatggggtaattttaactactccggaatatgatcactccattccagccgcacttaaaagtgcacttgaatggttaggttcacatgctggtcctaatgtaatggcaatgaagccagcagcagttgttggtacttcttacggtgttcaaggctcaagtcgtgctcaagaagatgcaagagaaattttgctttcacctgatatgagcgctaatgttttaccaggtaatgaagttttaatcggtggtgctgcaagtaattttgataaagaaactggcgatctgattaatgacggttacattaagcaacttgatcaaatgatgaataattttgttgaatttgttaatcaaattaataaa

SEQ ID NO: 246 - protein, 182 aa, Lactobacillus acidophilus
MNLLVIVGTNAPFSYNRFLAKFIAKRYGDKADIEVKEIDQIKPFCRSEEPDEITKQWIEDIKNSDGVILTTPEYDHSIPAALKSALEWLGSHAGPNVMAMKPAAVVGTSYGVQGSSRAQEDAREILLSPDMSANVLPGNEVLIGGAASNFDKETGDLINDGYIKQLDQMMNNFVEFVNQINK

SEQ ID NO: 247 - DNA, 1287 bp, Lactobacillus acidophilus
  CDS (1)...(1287)
  misc_feature (0)...(0): ORF 1892; adenylosuccinate synthase
atgacagcagttgcagttgtagggagccaatggggcgatgaaggtaaaggaaagattactgactttttaagtaaagatgccgcaatggcagttcgctcaaacggtggtaataacgcaggtcacaccattgatattgatggcaagactttcaagatgcgtttaattccttcaggaatttttgcagctaaggataacacagttattggtaatggtgttgtaattaacccagaagttatgtttagtgaacttgaaaatcttgaaaagaacggtattgatactagtggcttgagaatttctaaccgtgctcacattattatgccttacgacattaagcaagatgaataccaagaagaagctaagggtaaaaataagattggtactactaagaatggtattggtccaacttacatggataaagcttcaagaataggtattcgcgtttgtgatttactcgaaaaagatacttttgaagaaaagcttcgtactaatcttgaaattaagaacgaattatttactaaggtttatggtaaaccagctcttaaatttgaagatatttttgacaagtactatgaatatggtcaaagaatgaagaaatacgttactgacacttcagttttagtaaatgacgcgcttgaccaaaataagaaggttttatttgaaggggcacaaggtatcatgcttgatattgatgaaggtacttacccatttgtaacttcttcaaacactatttcaggtggtattgcttcaggtatcggtattggtgccaaccgtttggatactgtaattggtgtctgcaaagcttacactactagagtaggtgcaggtccattcccaacagaacttcttgatgagactggtgatcgtattcgtgaaattgctcatgaatatggtactgttactggtcgaccacgccgtgtgggttggtttgactccgttgctcttcgtcactcaaagcgtgttgctggtatcaatggccttagcttaaacttgcttgatgtattttcaggttttgacaagattaagatttgtactgcttatgaacttgatggtgaaaagattgattactatccagcaagtttaaaggaactttaccgttgtaagccagtttatgaagaacttccagcatgggaagaagatattactcaagttaagacttgggatgaacttccagaaaatgctaagaaattcttgaaccgtatttctgaattagtgggtgttccactagtgactgtttcagttggacctgaccgtgaacaaactatcgtattgaagaatccatgggaaatg

SEQ ID NO: 248 - protein, 429 aa, Lactobacillus acidophilus
MTAVAVVGSQWGDEGKGKITDFLSKDAAMAVRSNGGNNAGHTIDIDGKTFKMRLIPSGIFAAKDNTVIGNGVVINPEVMFSELENLEKNGIDTSGLRISNRAHIIMPYDIKQDEYQEEAKGKNKIGTTKNGIGPTYMDKASRIGIRVCDLLEKDTFEEKLRTNLEIKNELFTKVYGKPALKFEDIFDKYYEYGQRMKKYVTDTSVLVNDALDQNKKVLFEGAQGIMLDIDEGTYPFVTSSNTISGGIASGIGIGANRLDTVIGVCKAYTTRVGAGPFPTELLDETGDRIREIAHEYGTVTGRPRRVGWFDSVALRHSKRVAGINGLSLNLLDVFSGFDKIKICTAYELDGEKIDYYPASLKELYRCKPVYEELPAWEEDITQVKTWDELPENAKKFLNRISELVGVPLVTVSVGPDREQTIVLKNPWEM

SEQ ID NO: 249 - DNA, 960 bp, Lactobacillus acidophilus
  CDS (1)...(960)
  misc_feature (0)...(0): ORF 956; phosphofructokinase
atgaaacggattggtattttaactagtggtggagacgcccctggtatgaatgcagcaattagagctgtgacaaagactgctatccatcatggacttgaagtctttgggattcgttatggtttcgctggtttggttgcaggtgactttattccgcttactacggaaaatgttgaccacaagattagtgaaggcggtactttcttgtacagtgctcgcttccctgaatttgcacaagaagaagtgcaacaaaagggtgttgagcaactaaagaaacatggtattgatgctgttatcgttattggcggtgatggatcatatcatggtgctttagccttaactcgccacggcgtaaactcagttggtttaccaggaactatcgataatgatattccttatactgactacacgatcggctttgattctgcttgtcgtactgctatggatgcgattgacaagattcgcgacacagcaagtagtcaccaccgcgtattcgttgttaatgtaatgggtcgtgaatgtggtgatattgctatgcgtgtaggtgtagctagtggagcagatgcaattgttattcctgaacgtccttatgacgtaaaggaaattgcagaaactattaaacgtggttttgcagatggcaaagatcatggtatcattgtcttggcagaaggcgttatggatgccgaagaatttaaggatgaattacttaaatacggtgattttgatgctcgtgctaatgttcttgcacatatgcaacgtggtggctcaccaactgttgaagatagagtaaatgctactaagatgggtaactatgctgttaacttacttcttgatgggaagggcggtttagctgtcggcatggagaatggtaagttgaatacccacgacattttagatctatttgacagtaagcaccaaggcgacttttcactgctagatgttaatgaagaaatgactaaagat

SEQ ID NO: 250 - protein, 320 aa, Lactobacillus acidophilus
MKRIGILTSGGDAPGMNAAIRAVTKTAIHHGLEVFGIRYGFAGLVAGDFIPLTTENVDHKISEGGTFLYSARFPEFAQEEVQQKGVEQLKKHGIDAVIVIGGDGSYHGALALTRHGVNSVGLPGTIDNDIPYTDYTIGFDSACRTAMDAIDKIRDTASSHHRVFVVNVMGRECGDIAMRVGVASGADAIVIPERPYDVKEIAETIKRGFADGKDHGIIVLAEGVMDAEEFKDELLKYGDFDARANVLAHMQRGGSPTVEDRVNATKMGNYAVNLLLDGKGGLAVGMENGKLNTHDILDLFDSKHQGDFSLLDVNEEMTKD

SEQ ID NO: 251 - DNA, 3651 bp, Lactobacillus acidophilus
  CDS (1)...(3651)
  misc_feature (0)...(0): ORF 285; RNA polymerase DNA-directed beta subunit
ttgatcgacgtaaataagtttgaaagtatgcaaattggtcttgcatcacctaacaagatcagaagctggtcgtatggtgaagttaagaagccagaaaccatcaactaccgtactttaaagccagaaaaagatggcttgtttgatgaaagaatttttggaccaactaaagattggtcatgtgcttgtggtaagtacaagggtgttagataccgtggtatcgtttgtgaccgttgtggtgtagaagttacttcttcaaaggtaagaagagaacgtatgggtcacattgaattagctgctcctgtaactcacatttggtacttcaaaggtatcccatcaagaatgggattggtattggatatttctccaagattgcttgaagaagttatctactttgctgcgtatatcgtaattgatccaggtgatactgaccttgaacctaagcaattgttaactgaagctgaatatcgtgaacaaaaagcaaaatacggtaatcgctttgaagctaagatgggtgctgaagctattcgtgaattgcttaagaaggttgaccttgataaagaagttaagaatttgaagaaagaacttcaaactgcaactggtcaaaagcgtactcgtgcaattagacgtttagatattttggatgcatttaagaattctggtaacaaacctgaatggatggttatggatgctgttccagttatcccaccagatcttcgtccaatggttcaacttgaaggtggacgttttgcaacttcagatttgaacgatttatatagacgtgtcattaaccgtaataatcgtttgaagagattacttgacttgaatgctccaaatattatcgttcaaaatgaaaagcgtatgcttcaagaagctgtagatgctttgatcgataatggacgtcgtggtcgtcctgttgttggaccaggtaaccgtccacttaagtcactttcacacatgcttaaaggtaagcaaggtcgtttccgtcaaaacttgcttggtaagcgtgtagactattctggtcgttcagttattgatgtttcaccaaaattgaagttctatcaatgtggtgttcctcgtccaatggctttggaattgtttaagccatttgtaatgcacgaattggttaagcgtggtattgcttctaacattaagaatgctaagcgtaagattgatcgtgaagatgatgatatctgggacgtacttgaagacgttattaaggaacgtccagttcttttaaaccgtgcacctactcttcaccgtttgagtattcaagcatttgaacctgttttggtaccaggtaaatcaattagacttcacccattagcttgtgaagcttacaatgccgacttcgatggtgaccagatggccatccacgtaccactttcagatgaagctgttgctgaatcacgtttgcttatgcttgcagctcaccatatcttagctcctaaggatggtaagccaattgttactccatcacaggatgttgttttgggtaactactggttaactcaagctgaacgtggccgtgaaggcgaaggcatgatctttagttcaccagcagaagcaactgtagcttacgaaaatggtgatattcactatcatactattattggtatgtcagctgatgctatgcctaagaagccatggcctaagggacacgaacatggtattttcattactacttacggtaagcttgtctttaatcaattgttcccagacgattacttttatgtcaatgaaccaactgagaagaacttgaatgatccattggatgctaagtacttcttaaatgaaggtgaagatattaatagtaaaatcaatgaagtggctgatgatttgatcgctagtccattcaagagtagcttcttatcagattcaattgctactatttacaagtattacaaggttcaaagaacttcagaatacttggatgacttgaaggaattaggttacactagttcaactacttcaggtattactattggtatgaatgacgttcctgaaattggtgataaagatgaaaaggtagctaaagcacgtaagcaagttgatgttgtttctaaacaatttagacgtggtttaattactgaacaagaacgtcacgatcgagtaattagtatttggaatgcatgtaaggatgaaatccaaaacgaaattgctcaaatccactcaccacgtaacccaatttcaatcatggccgactcaggtgcccgtggtaacatttctaactttactcagttagctggtatgcgtggattgatggccactcctaacggtggtttgttcgaaattcctgttacttcaaactttaaagaaggtttgtcagtattggaattgttcatgtccactcacggtgctcgtaagggtatgactgatacagctttgaagactgctcagtcaggttacttaactcgtcgtttggttgatgttgcacaggatgttattattcgtgatgatgattgtggtactgatagaggtattacagttagtgcaattatggaaggcgacgaaatgattgaaccattattcgatcgtttagttggtcgtttcactgctgaaactgttaaggatcctgagactggtgaagcaatcgttggtagagacgtaatgatggacgaaaacatggctcataagatctgtgatgcaggtgtaactcatgttaagattcgttcaatccttacttgtgataccccacacggtgtatgtcgtaagtgttacggtatgaaccttgctactggtgaagaagttgaagttggtgaagcagttggtactgttgcagcacaatcaattggtgaaccaggtactcagcttactttgagaactttccacaacggtggggttgccggtgctgaagatattactcaaggtttgcctcgtgttcaagaattgtttgaagcacgtaaccctaagggtcgtgcaaccatttctgaagtagatggtgtaattgattcaattcaagaaaatccagcagaacatactcgtgaaattactgttaagggtaaaattgatactagaagttacagtgttccttatactgcttcagttgctgtatctgagggtgattatgttcaccgtggtgataagttaactcttggttctgttgaccctaaggaattaatccaagttactgatactttaactactgagaagtatattttggctgaagttcaaaaggcctacagaatgcagggtgtagatatcgctgacaagcacgtcgaagtattgactcgtcaaatgcttcaaaaggttcgtgttcttgatccgggtgaaactgacatcttaccaggtgaagttatggatatcggtcaatttagagaccgtaataaggaagtaattatctctggtggtattcctgcaactgctcaaagtattatcttaagtattactaaggctgctttggaaactaacagtttcttgtcagctgcttcattccaagaaactactcgtgttcttactgatgcttcaatcagaggtaagaatgatccgcttcttggtcttaaggaaaatgttatcatcggtaaaattattccagctggtactggtatgccaatttaccgtagcatggaacctgaagctgatgttaagaaaccagattcagtatactcaattgctgatattgaaaagcaaatgaaagaaaaagataagactaag

SEQ ID NO: 252 - protein, 1217 aa, Lactobacillus acidophilus
MIDVNKFESMQIGLASPNKIRSWSYGEVKKPETINYRTLKPEKDGLFDERIFGPTKDWSCACGKYKGVRYRGIVCDRCGVEVTSSKVRRERMGHIELAAPVTHIWYFKGIPSRMGLVLDISPRLLEEVIYFAAYIVIDPGDTDLEPKQLLTEAEYREQKAKYGNRFEAKMGAEAIRELLKKVDLDKEVKNLKKELQTATGQKRTRAIRRLDILDAFKNSGNKPEWMVMDAVPVIPPDLRPMVQLEGGRFATSDLNDLYRRVINRNNRLKRLLDLNAPNIIVQNEKRMLQEAVDALIDNGRRGRPVVGPGNRPLKSLSHMLKGKQGRFRQNLLGKRVDYSGRSVIDVSPKLKFYQCGVPRPMALELFKPFVMHELVKRGIASNIKNAKRKIDREDDDIWDVLEDVIKERPVLLNRAPTLHRLSIQAFEPVLVPGKSIRLHPLACEAYNADFDGDQMAIHVPLSDEAVAESRLLMLAAHHILAPKDGKPIVTPSQDVVLGNYWLTQAERGREGEGMIFSSPAEATVAYENGDIHYHTIIGMSADAMPKKPWPKGHEHGIFITTYGKLVFNQLFPDDYFYVNEPTEKNLNDPLDAKYFLNEGEDINSKINEVADDLIASPFKSSFLSDSIATIYKYYKVQRTSEYLDDLKELGYTSSTTSGITIGMNDVPEIGDKDEKVAKARKQVDVVSKQFRRGLITEQERHDRVISIWNACKDEIQNEIAQIHSPRNPISIMADSGARGNISNFTQLAGMRGLMATPNGGLFEIPVTSNFKEGLSVLELFMSTHGARKGMTDTALKTAQSGYLTRRLVDVAQDVIIRDDDCGTDRGITVSAIMEGDEMIEPLFDRLVGRFTAETVKDPETGEAIVGRDVMMDENMAHKICDAGVTHVKIRSILTCDTPHGVCRKCYGMNLATGEEVEVGEAVGTVAAQSIGEPGTQLTLRTFHNGGVAGAEDITQGLPRVQELFEARNPKGRATISEVDGVIDSIQENPAEHTREITVKGKIDTRSYSVPYTASVAVSEGDYVHRGDKLTLGSVDPKELIQVTDTLTTEKYILAEVQKAYRMQGVDIADKHVEVLTRQMLQKVRVLDPGETDILPGEVMDIGQFRDRNKEVIISGGIPATAQSIILSITKAALETNSFLSAASFQETTRVLTDASIRGKNDPLLGLKENVIIGKIIPAGTGMPIYRSMEPEADVKKPDSVYSIADIEKQMKEKDKTK

SEQ ID NO: 253 - DNA, 924 bp, Lactobacillus acidophilus
  CDS (1)...(924)
  misc_feature (0)...(0): ORF 1201; GTP-binding protein Era
atgaaggcagaggtaaataatatggaagaaaaagaatttaaatctggcttcgttgccttagttggccgtcctaatgttggtaaatcaacattgatgaattatttagtcggtcaaaaagtggcgattacgtcaaataaacctcagacaacgagaaatcgtatctcgggtatatatacttcagatagaatgcaagttatttttgttgatacaccgggaatctttaaacctcattcaaaacttgacgactatatggataaagctagtttatctagtttaaatgatgttgatctagttttattcatggttgaacctgaggatatgggtaaaggtgaccaatatattgctgacttgctcaaagaagttaaagttccagtatttttggtaattaataaggttgatcaaattcatcctaataagttattaccgattatggattcataccataaacttgatggctttaaagaaatactaccgatttctgctactcaaggcattggtattgatgatttgctcaatacaatctataagtatttaccagcaggaccacaatattatgatgcagatcagatcacagatcgtcctgaatattttgtggttgcagaacttattcgagaacaaattttacgacttacttctcaagaagttccacatgctactgcagttgtagtcgatcaaatgaataagcatcaaaatggtaaattagttattgaagcaactatttatgttgaaagagatggccaaaagggcattatcatcggcaagggtggtaagatgctcaagcaaatcggaattgattcacgtaaggaaattgaaagattacttggtgaaaaagtaaatttgcgtttatgggtaaaggttcaacataattggcgttcagatccaagtttcttgaaacaaattggttatgataaaaaagaacttgga

SEQ ID NO: 254 - protein, 308 aa, Lactobacillus acidophilus
MKAEVNNMEEKEFKSGFVALVGRPNVGKSTLMNYLVGQKVAITSNKPQTTRNRISGIYTSDRMQVIFVDTPGIFKPHSKLDDYMDKASLSSLNDVDLVLFMVEPEDMGKGDQYIADLLKEVKVPVFLVINKVDQIHPNKLLPIMDSYHKLDGFKEILPISATQGIGIDDLLNTIYKYLPAGPQYYDADQITDRPEYFVVAELIREQILRLTSQEVPHATAVVVDQMNKHQNGKLVIEATIYVERDGQKGIIIGKGGKMLKQIGIDSRKEIERLLGEKVNLRLWVKVQHNWRSDPSFLKQIGYDKKELG

SEQ ID NO: 255 - DNA, 3639 bp, Lactobacillus acidophilus
  CDS (1)...(3639)
  misc_feature (0)...(0): ORF 284; RNA-polymerase DNA-directed beta subunit
ttgttaaatggacacgtagtgaactacggtaaacatcgaactagacgtagcttctcccgaattaaggaagtattgaagttacctaacttaactgatgttcaaaccgaatcatataagtggtttcttgataaaggcattaaagaagtctttgatgacattatgcctattagtgacttctcaggtaagctttcattagagtatgtaggctacaaacttcaaaagcctaagtatacagttgatgaagctcgtgatcatgatgcaacttatgctgcaccaatgcatgtaactttgaagcttactaaccaagaaactggtgaaattaagactcaagatgtattctttggcgatttaccattaatgactgaatcaggttcattcatagttaatggtgctgaaagagttattgtttctcaattagttagatctccaggtgtttactacactggtgattatgataagaatggtcgtcaaatttttggtactactgttattcctaaccgtggtgcttggcttgaatatgaaactgatgctaaaaatgtttcttatgttcgagtagaccgtactcgtaagttgcctcttactgtattgattagagcaatgggtattggctcagacagtgaaattattgaaatgtttggtcaaagtgatactttgcaatttactttggacaaggatgttcataaaaatccagctgactcacgcgtagctgaagctttgaaggatatttacgaaagacttcgtccaggtgaaccaaagactactgattcatcacgttcacttttgtatgctcgtttctttgacccacgtcgttatgacttggcaccagttggacgttacaagattaacaagaagctttctcttaagaatcgtttgtatggtcaaactttagctgaaactttagctgatcctgatactggtgaaattattgttaagaaggatactgtagttactcacgaaattatggacaagttagctccataccttgatcgcgatgacttcaagatggtcacttaccaaccttcaaaagaaggtgtattaccagatcctattacagttcaagaaattaaggtttactcaaaggtagatcctgaacgtgaagttaaattaatgtcaaatggtcacattgatgcagatgttaagcatttgactccagctgatgttttagcttcaattaattacttctttgctttacaagataagatcggtactactgatgatatcgaccacttgggtaaccgtcgtattcgtcgtgttggtgaacttcttcaaaatcaatttagaattggtttggcaagaatggaacgtgttgttcgcgaaagaatgtcaatccaagacccatcaactgttaccccacaacaattgattaacattcgtccaattgttgcaagtatcaaggaattcttcggttcatcacagctttcacagtttatggaccaacacaacccattgggtgaattgacacataaacgtcgtatgtcagccttagggcctggtggtttaactcgtgaccgtgccggatatgaagttcgtgacgttcactatactcactatggtcgtttgtgtcctattgaaactccagaaggacctaacattggtttgattaactcacttgcttcatacgcaatcattaataagtatggtttcattgaaacaccatatcgtcgtgtttcttgggatacccacaaggtaaccgataaaatcgattatttgactgctgatgaagaagataactacattattgccggtgctaacactcctttgaatgatgatggttcatttaaagaagacataattttggctcgtcaaaaggaagataacgtcgaagttactccagataagattgactacatggacgttatccctaagcaagttgtttcagtagcttcagcatgtatcccattcctagaaaacgatgactctaaccgtgctttgatgggtgccaaccagcaacgtcaggctgctcctttgattaacccacacagttcccttgttggtactggtatggaatatcgtgcagctcacgactcaggtgctgcattaattgctaaggcagctggtactgttgaatacgttgatgctgatgaaattcgtattagacgtgaagatggtactttagacaagtacactcttgaaaaataccgtcgttcaaacaactctaagtcatacaaccaaactcctaatgttaaattgggtgatcacgttgatgaaagtgatgtaattgctaatggtccaactatggatcatggtgaacttgcattaggtcaaaacccactcattgctttcatgacttggaacatgtacaactatgaagatgccatcatgctttcagaacgtttggttaaggatgatgtatatacttcaattagtatcgaagattatgaatcagaagctcgcgatactaagcttggaccagaagaaattacaagagaacttcctaacatcggtgaagatgctttgaaggatcttgatgctgatggtatcgttcgtgtcggtgctgaagttcatgatggtgatattttggtgggtaaggtaactcctaagggtgtaactgaattatctgctgaagaaagattacttcacgctatctttggtgaaaaggctcgtgaagttcgtgatacttcacttcgtgtaccacatggtggtggcggtatcgttcaagacgttaaggtttatactcgcgaagccggcgatgaactttcaccaggtgtaaatactatggttcgtgtttacattgcacaaaagagaaagattcaagttggggacaagatgtctggtcgtcacggtaacaagggtactgttgctgcagttatgccagaagaagatatgccataccttccagatggtactccagtagatatttgtttgaacccaatgggtgttccatcacgtatgaacattggacagcttcttgaattgcacttgggtgctgctgctcgtcaattaggtattcacgtagcaactccagtatttgatggtgctaatgaaaatgatgtttgggatactgtacgtcaagcgggtatggataaagatggtaagacagttatttatgatggtcgtaccggtgaaccattccacaaccgtgtgtcagtaggtgtcatgcactacttgaaacttactcacatggttgacgacaagatccacgctcgttcaattgggccatactcattggttactcaacaacctttgggtggtaaagctcaattcggtggacagcgttttggtgaaatggaagtttgggctcttgaagcttatggtgcagcttacacattacaagaaattttgacttataagtcagatgatgttgttggtcgtgtaaaggcatatgaagctattgttaagggcgaaagaattcctaagccaggtgtaccagaatcattccgtgttcttgttaaggaactccaatcattaggtttggatattcgtgtccttgatatggatcataatgaaattgaacttcgtgatatggatgaggattcaagtgaacacttgaatatcgatactttgtcacgtatggcagaagaacaagaaaagaagaagttagccgaagaaactggaaaatcagagaataaagaagatagtaatgaaactgcagataagccagtagctcctgcagatgaatctgacggtaaagtttctaaa

SEQ ID NO: 256 - protein, 1213 aa, Lactobacillus acidophilus
MLNGHVVNYGKHRTRRSFSRIKEVLKLPNLTDVQTESYKWFLDKGIKEVFDDIMPISDFSGKLSLEYVGYKLQKPKYTVDEARDHDATYAAPMHVTLKLTNQETGEIKTQDVFFGDLPLMTESGSFIVNGAERVIVSQLVRSPGVYYTGDYDKNGRQIFGTTVIPNRGAWLEYETDAKNVSYVRVDRTRKLPLTVLIRAMGIGSDSEIIEMFGQSDTLQFTLDKDVHKNPADSRVAEALKDIYERLRPGEPKTTDSSRSLLYARFFDPRRYDLAPVGRYKINKKLSLKNRLYGQTLAETLADPDTGEIIVKKDTVVTHEIMDKLAPYLDRDDFKMVTYQPSKEGVLPDPITVQEIKVYSKVDPEREVKLMSNGHIDADVKHLTPADVLASINYFFALQDKIGTTDDIDHLGNRRIRRVGELLQNQFRIGLARMERVVRERMSIQDPSTVTPQQLINIRPIVASIKEFFGSSQLSQFMDQHNPLGELTHKRRMSALGPGGLTRDRAGYEVRDVHYTHYGRLCPIETPEGPNIGLINSLASYAIINKYGFIETPYRRVSWDTHKVTDKIDYLTADEEDNYIIAGANTPLNDDGSFKEDIILARQKEDNVEVTPDKIDYMDVIPKQVVSVASACIPFLENDDSNRALMGANQQRQAAPLINPHSSLVGTGMEYRAAHDSGAALIAKAAGTVEYVDADEIRIRREDGTLDKYTLEKYRRSNNSKSYNQTPNVKLGDHVDESDVIANGPTMDHGELALGQNPLIAFMTWNMYNYEDAIMLSERLVKDDVYTSISIEDYESEARDTKLGPEEITRELPNIGEDALKDLDADGIVRVGAEVHDGDILVGKVTPKGVTELSAEERLLHAIFGEKAREVRDTSLRVPHGGGGIVQDVKVYTREAGDELSPGVNTMVRVYIAQKRKIQVGDKMSGRHGNKGTVAAVMPEEDMPYLPDGTPVDICLNPMGVPSRMNIGQLLELHLGAAARQLGIHVATPVFDGANENDVWDTVRQAGMDKDGKTVIYDGRTGEPFHNRVSVGVMHYLKLTHMVDDKIHARSIGPYSLVTQQPLGGKAQFGGQRFGEMEVWALEAYGAAYTLQEILTYKSDDVVGRVKAYEAIVKGERIPKPGVPESFRVLVKELQSLGLDIRVLDMDHNEIELRDMDEDSSEHLNIDTLSRMAEEQEKKKLAEETGKSENKEDSNETADKPVAPADESDGKVSK

SEQ ID NO: 257 - DNA, 1794 bp, Lactobacillus acidophilus
  CDS (1)...(1794)
  misc_feature (0)...(0): ORF 1763; oligopeptidase
atggcaattccaacaagaagtgaagttccagaagaattaaaatgggacttaacccgtgtttttaagacagatgaagactgggaagcagcctttgataatgcaaaagatgaagtagaaaaattaggtgattttaaaaaaatccttactaaatctggcaaagacttatacgaaagtttgacccaaattttagcagttaaacgtcaagtagaaaatatttacgtttatgcaactatgtctagtgatgttgatacttcaaattctcactatttaggttatgtaagccgcgcacaaaatttagttaaccaatttgaggcagtaactagttttatcagcccagaaattctgagtatccctgccgataagtttgaacaattcaaaaaggatgaacctcgtttaaacgattatgctcactatcttgagacaatcactaataagcgtccccacactttacctgctgaagaggaaaaaattatcgcagatgccagtgatgccatgggcgtttcagaaaatacctttaacgttttaactaattcagacatggaatatggctacgttcaagatgacgatggtaatatggaacaattgtctgacggtttgtactcacttttaatccaatcacaaaaccgtgatgtcagaaaaggcgcttttgatacgctttatgcaagctatggtcaattccaaaattcacttgcttctacgctttccggcgttgtaaagaagcacaattataacgctaaagttcacaagtatgattcagctcgtgaagcagctttagctgaaaacaacgtacctaccaaggtttacgacactttgattcgagaagttgactcccatcttgatttacttcaccgttatgtagcacttcggaagaaaattttgggacttaaagatttacaaatgtgggacatgtacgtgccactaactggtaagcctgctctttcatataattttgaagaagcaaaggaagtagctaagaaagctttagctccactgggcgaagattacttaaagcatgttgattatatctttaataatcgcgtaattgatgtagttgaatcaaagaataaagtaactggcgcatattctggcggtgcttatgatacagatccatatgaacttttaaactgggaaaacaacattgactccttatatactctagttcacgaaactggtcactcagttcactcttggtacactcgcaatagccaaccttacgtttatggggattatcctattttcgtagcagaaattgcttcaaccactaacgaaaatattttgactgaatacttcttagatcatattactgattctaagacacgcgcctttattttgaactactatcttgattcatttaaggggacattgttccgtcaaacccaatttgcggtgtttgaacaatttattcatgaagcagatgctaaaggtgaaccacttactgctgatatcttggatgaagtttatggacaacttaaccaacactattacggtgacagcgttgagccaggcggcgatattgcacttgaatggtcacgtatcccgcacttctactacgacttttacgtttaccaatatgcaacaggatttgcggctgcaacagctcttgccaacaaggtggttcatggttctgaagctgatagggatgcatatcttggttttcttaaggctggttcaagtaactatccaaccgaaattatgaagcatgctggcgttgatatgactaagccagactacttggaagatgcatttaagacatttgaaaaacgtttagccgaatttgaaagtttgattgaaaaa

SEQ ID NO: 258 - protein, 598 aa, Lactobacillus acidophilus
MAIPTRSEVPEELKWDLTRVFKTDEDWEAAFDNAKDEVEKLGDFKKILTKSGKDLYESLTQILAVKRQVENIYVYATMSSDVDTSNSHYLGYVSRAQNLVNQFEAVTSFISPEILSIPADKFEQFKKDEPRLNDYAHYLETITNKRPHTLPAEEEKIIADASDAMGVSENTFNVLTNSDMEYGYVQDDDGNMEQLSDGLYSLLIQSQNRDVRKGAFDTLYASYGQFQNSLASTLSGVVKKHNYNAKVHKYDSAREAALAENNVPTKVYDTLIREVDSHLDLLHRYVALRKKILGLKDLQMWDMYVPLTGKPALSYNFEEAKEVAKKALAPLGEDYLKHVDYIFNNRVIDVVESKNKVTGAYSGGAYDTDPYELLNWENNIDSLYTLVHETGHSVHSWYTRNSQPYVYGDYPIFVAEIASTTNENILTEYFLDHITDSKTRAFILNYYLDSFKGTLFRQTQFAVFEQFIHEADAKGEPLTADILDEVYGQLNQHYYGDSVEPGGDIALEWSRIPHFYYDFYVYQYATGFAAATALANKVVHGSEADRDAYLGFLKAGSSNYPTEIMKHAGVDMTKPDYLEDAFKTFEKRLAEFESLIEK

SEQ ID NO: 259 - DNA, 2061 bp, Lactobacillus acidophilus
  CDS (1)...(2061)
  misc_feature (0)...(0): ORF 1198; glycyl-tRNA synthetase beta chain
atggctaaagattatttatttgaaattggtactgaagaaatgcctgctcacgttgtaccacgcagcgttagccaattagcagacagaaccagaaaatttttaaaagaaaatggcttaaagttcaaagatatcaaaactttttcaactccacgtcgtttgactattcttgtcgaagatttagctgaaaagcaggacgatattgatgaagttaagaaagggccagctaagaagattgcgcaagatgctgatggtaattggaccaaggctgcgcaaggttttgctcgcggtcaaggtatgactactgatgacatctactttgaagagcttaagggcactgaatatgcttatgttcacgttcaaaaggaaggtaaaaaagctagtgatatcttacttggtatgagtgaaatcattaaagctatgacttttcctactaagatgcgttgggattcaaatgactttgaatttgttcgtccaatccattggcttgtatcattattcggcaatgaagtgatcccagttaagattttggatattactgctggtcgcaagactgaaggtcatcgtttcttgggtgattcagttgtattagctaatgcggatgactatgaagacgcattgaaagatcaatatgtaattgctaacgctgaagaacgcaaagatatgattgttaaccaaatggatgaactggttaaggaaaatcattggcaagttaaacctgatcgtgatcttctggaagaagttacttatttagtagaatatccaactgtctttgctggctcatttgatgaaaagtacttaaatattccagatgaagtattaattacttcaatgaaggataaccaaagatactttgaagtttatgatgaaaatggtaaactaattaatcactttattgctgtaagaaacggtaataaagattatcttgacaatgttatctcaggtaatgaaaaggttttagttgctcgcttagatgatgctcaattcttctacgatgaagaccgtaaatacccacttagtcactttgtcgatcgtcttaaagatgtttcattccatgataagattggttcaatggctgaaaaggttcaacgtgttcgtatgatcggtgactatcttgctaagcgttggaacctgccagaaaatgtcgttaaggactttgatcgtgctagtgaactatacaagtttgatttagttactcaaatggttggtgaatttgccgaacttcaaggtgtaatggggatgcattatgctcgtcttgctggcgaagatgaagaagtttcagtagcaattaaggaacactacatgccagctactgcagaaggtccgcttccagaaactactgtaggttcacttttgtcaattgctgataagattgatactattatcactttctttggtgcaggtatgatcccaacttcatctaatgacccatatgctcttcgtcgttatgcttatggtattgttagaatcttattgaatgagaaatggtcattaccatttaacgaagtattaccagaaattattagtttacttaatggtgtaactccagctagacttcctaagagtgatgttgatcaagaaattgctgactttattcgtgatcgtgtaaagcaatacttacaaaagaataaatttaagtacgacattattgatgctgtacttgcttcaagtcaacaagatccaagtcaaattttagcagcagctaatgtattgcagcttcaccacgacgatgaagaatttaagccagttgttgaaagtttaactagaattgacaacatcctgaagaaggctaagttcaagggtaatgtagaagttgacgaaagtttatttgaagataatagcgaaaaagaactttatgttggtgtgcaaaacttgcaagaaattgaaagtttggcagatctttaccaaggatttgttcaattacagccagtcattgatcaatactttgacgtcaacatgatcatggataagaatgaaaaggttaaaaataaccgtttagcacagctttacgctgttagtgaactggctgatcgcttaggtaacttaagtaaattagttattaaa

SEQ ID NO: 260 - protein, 687 aa, Lactobacillus acidophilus
MAKDYLFEIGTEEMPAHVVPRSVSQLADRTRKFLKENGLKFKDIKTFSTPRRLTILVEDLAEKQDDIDEVKKGPAKKIAQDADGNWTKAAQGFARGQGMTTDDIYFEELKGTEYAYVHVQKEGKKASDILLGMSEIIKAMTFPTKMRWDSNDFEFVRPIHWLVSLFGNEVIPVKILDITAGRKTEGHRFLGDSVVLANADDYEDALKDQYVIANAEERKDMIVNQMDELVKENHWQVKPDRDLLEEVTYLVEYPTVFAGSFDEKYLNIPDEVLITSMKDNQRYFEVYDENGKLINHFIAVRNGNKDYLDNVISGNEKVLVARLDDAQFFYDEDRKYPLSHFVDRLKDVSFHDKIGSMAEKVQRVRMIGDYLAKRWNLPENVVKDFDRASELYKFDLVTQMVGEFAELQGVMGMHYARLAGEDEEVSVAIKEHYMPATAEGPLPETTVGSLLSIADKIDTIITFFGAGMIPTSSNDPYALRRYAYGIVRILLNEKWSLPFNEVLPEIISLLNGVTPARLPKSDVDQEIADFIRDRVKQYLQKNKFKYDIIDAVLASSQQDPSQILAAANVLQLHHDDEEFKPVVESLTRIDNILKKAKFKGNVEVDESLFEDNSEKELYVGVQNLQEIESLADLYQGFVQLQPVIDQYFDVNMIMDKNEKVKNNRLAQLYAVSELADRLGNLSKLVIK

SEQ ID NO: 261 - DNA, 912 bp, Lactobacillus acidophilus
  CDS (1)...(912)
  misc_feature (0)...(0): ORF 916; citrate lyase beta chain
atgacttatattaaaaatcgtttgcgtagaacgatgatgtttgtcccaggaaacaaccctgcgatgattaaagatgctggtatttatggtgctgattcaatcatgttggatttagaagattcagtgtctttaactgaaaaagatgctgctagaatgctggtttatgaagcgattaaaactattgactttggcgatagtgaaatcgtagttagagttaatggacaagatacaccattttatgatgaagatgttcgtgcgatggttaaggctggtgttgatgtaattcgtttgccaaaaactgaatcagcagcgatgattcaaaaattggttaaggacattgaacactgggaagatgaatacggcatcgaaaagggctctattggtgtgatggctgctattgaaagtgctaaaggcgtattgaatgctccagaaattgctactgcaacaccattaatgatgggtcttgctgtttcaggtgaagattacactgcggatatgcatacgcatcgttatccagatggccgtgaacttgaatttgcacgtaatatggtgttacaagcagcacgtgcagctaatgtttatgcctttgatacggtattttctaatatgaaggatacagaaggcttttatcgtgaaactaattatattcatgaattggggtatgacggtaaaagtttggttaacccgcgtcaaattgaaatggttaatgaagtctttaatccaactaaagaagaaattgaacaagctaaaaatgttgaaaatgctattcgggaagctaaggctaagggttcaggtgtaatttcacttaatggtaagatggttgataaaccagttgtagaaaaggcaacccgcgttcttgaaactgctaaagcttctaacttgattgatgaagaaggtaactacattggagaa

SEQ ID NO: 262 - protein, 304 aa, Lactobacillus acidophilus
MTYIKNRLRRTMMFVPGNNPAMIKDAGIYGADSIMLDLEDSVSLTEKDAARMLVYEAIKTIDFGDSEIVVRVNGQDTPFYDEDVRAMVKAGVDVIRLPKTESAAMIQKLVKDIEHWEDEYGIEKGSIGVMAAIESAKGVLNAPEIATATPLMMGLAVSGEDYTADMHTHRYPDGRELEFARNMVLQAARAANVYAFDTVFSNMKDTEGFYRETNYIHELGYDGKSLVNPRQIEMVNEVFNPTKEEIEQAKNVENAIREAKAKGSGVISLNGKMVDKPVVEKATRVLETAKASNLIDEEGNYIGE

SEQ ID NO: 263 - DNA, 522 bp, Lactobacillus acidophilus
  CDS (1)...(522)
  misc_feature (0)...(0): ORF 1202
atggatccaattgatattacttacaatgacgaggttggctttttagatgatgaaaagcgtgactggaaaacctggattatgaaacttttgcttttagcaaagaaagaaatcggcaaggataacaatttggaaatgagcattaactttgttaatgaagatcgcagtcatgagataaatttaaaatatcgcgataaagatcgcccgactgatgttatctcttttgcaattgaagatggtgaggattcaattgatttagctgcttttaaagatgatccagattttcaagaagatattggtgatttatttatgtgtcctagtgtgatctcacgtcatagcaaggaatatggtacggggtttgaccgagaatttggttatacaatagttcatggctttttgcatttaaatggatatgatcacattgaacctgatgaagccaaagaaatgtttggtattcaaggaaaagtgttagaagattatggactaccattgtatcctgatcaattagatgaaggcagaggtaaa

SEQ ID NO: 264 - protein, 174 aa, Lactobacillus acidophilus
MDPIDITYNDEVGFLDDEKRDWKTWIMKLLLLAKKEIGKDNNLEMSINFVNEDRSHEINLKYRDKDRPTDVISFAIEDGEDSIDLAAFKDDPDFQEDIGDLFMCPSVISRHSKEYGTGFDREFGYTIVHGFLHLNGYDHIEPDEAKEMFGIQGKVLEDYGLPLYPDQLDEGRGK

SEQ ID NO: 265 - DNA, 1485 bp, Lactobacillus acidophilus
  CDS (1)...(1485)
  misc_feature (0)...(0): ORF 267; ATP-dependent RNA helicase
ttgaaattttcagaattaggattaaacgaagcgcttcttaaagcgattaaacgctcaggatttgaagaagcaactccaatccaggaacaaactattccccttgctctagagggtaaggatgtaattggccaagcacaaactggtactggtaagactgctgcatttgggttaccaattttacaaataattgataaaaaagaaaaggcaattcaagcaattattattgaaccaactcgtgaacttgctattcagactcaagaagagctctttcgtttaggtcgcgatgaacgtgcacatgtacaagtagtatatggtggtgctgatattggccgtcaaattcgttcattaaagcatcatgtaccatcaattttagtggggacaccaggccgtttacttgatcatttaaagcgtggcacaattgacttagataaagttaagactgtagttttagatgaagcagatgaaatgcttgatatgggatttattcaagatattgaaagtattttgaaatatgctaagaatcgtaatcaaacattgcttttcagtgcaacaatgccaaagccaattttgcgaattggtgaaaagttcatgaacaatcctgaaattgttcaaattaaagctaaagaacttactgcagatttaattgatcaatactttgttcgtgcaaaggaatcagaaaaatttgatattatgtgtcgtttaattgatgtacaaggaccagatttagctgtggtctttggtcgaactaagcgacgcgtagatgaacttacacgcggtttacaagctcgtggctacaatgctgcaggaattcacggtgacttatcacaagcacgtagaatggccgtattgaagcgattccgtgaaggtaagcttgatattttggtcgcaacggacgttgctgctcgtggacttgatatttcaggtgtaactcacgtttataattacgatattccacaggatcctgactcttatgttcaccgtatcggcagaactggacgtgcaggtcaaaacggaatttctgttactttcgtaacacctaatgaaattggctatatgcgtacaattgaacaacttaccaagaagaagatgtcaccacttcgtccaccaacagacgatcaagcacttcgtggtcaattgaaacaagctaaggcacaaattgaagacttaataaatagtgatcttggtaaatatacccaagatgctagtgaacttttggataattattctgcagttgatttagttgctgcatttttaaagaatttatctaaggattcaactgatattaaggttaagattacaccagaaaaaccattaccatacaagggcgatggtcgccgtaatcgtagaggacacggtcgtggccgcaacaataatcgcaatcatggcaattatcgtcgccgtaataataattatcgccataatggtaatcgcggcaaacgtggtcgtggcaatggacacgaatttgttattaaaagcaaagaaaag

SEQ ID NO: 266 - protein, 495 aa, Lactobacillus acidophilus
MKFSELGLNEALLKAIKRSGFEEATPIQEQTIPLALEGKDVIGQAQTGTGKTAAFGLPILQIIDKKEKAIQAIIIEPTRELAIQTQEELFRLGRDERAHVQVVYGGADIGRQIRSLKHHVPSILVGTPGRLLDHLKRGTIDLDKVKTVVLDEADEMLDMGFIQDIESILKYAKNRNQTLLFSATMPKPILRIGEKFMNNPEIVQIKAKELTADLIDQYFVRAKESEKFDIMCRLIDVQGPDLAVVFGRTKRRVDELTRGLQARGYNAAGIHGDLSQARRMAVLKRFREGKLDILVATDVAARGLDISGVTHVYNYDIPQDPDSYVHRIGRTGRAGQNGISVTFVTPNEIGYMRTIEQLTKKKMSPLRPPTDDQALRGQLKQAKAQIEDLINSDLGKYTQDASELLDNYSAVDLVAAFLKNLSKDSTDIKVKITPEKPLPYKGDGRRNRRGHGRGRNNNRNHGNYRRRNNNYRHNGNRGKRGRGNGHEFVIKSKEK

SEQ ID NO: 267 - DNA, 909 bp, Lactobacillus acidophilus
  CDS (1)...(909)
  misc_feature (0)...(0): ORF 1599; fructose bisphosphate aldolase
atggcttattttgtaaatggtaacgaaatcttcagagaagctcgtaaacaccactacgctgtaggtgcttacaacactaacaacttggaatggactcgtgcagaattacgtgctgcagaagaaactagaactccacttttgatccaagtttcaactggtgctgctaagtacatgggtggctataagttcgttaaggacatggttgaagaccaaatggactcaatgaacatctctgttccagttatcttaaacttggaccacggtgactttgaatcagctaaggaatgtattgcacttggttactcatcagttatgtttgatggtcacgcacttccaactgaagaaaacttggctaagactaaggaaattatcaagttggctcacgaacgcggtatttctgttgaagctgaaattggtaagatcggtgaaaaccaaggcggcggtgaattagcttctgttgaagatgctaaggcattcgttgaagctggtgttgacaagcttgcttgtggtattggtaacatccacggtgtttacccagcagactggaagggtcttaacttcgatcgtttgaaggaaattgctgaagctgttcctgaaactccacttgtacttcacggtggttcaggtattcctgaagaccaaatcaagaaggctatccaacttggtatttcaaaggttaacatcaacactgaattccaattagcattccaagaagcaactcgtaagtacatcgaagaaggcaaggacgaagacaaggctaacaagggttacgacccacgtaagttgttattgccaggtactgaagcaatcactgacaagatgaaggaaatgattgcttggttaggtactaagactatcgatgacgaacttaaggatgctttattcgaccgttcatcattgaacgaagaa

SEQ ID NO: 268 - protein, 303 aa, Lactobacillus acidophilus
MAYFVNGNEIFREARKHHYAVGAYNTNNLEWTRAELRAAEETRTPLLIQVSTGAAKYMGGYKFVKDMVEDQMDSMNISVPVILNLDHGDFESAKECIALGYSSVMFDGHALPTEENLAKTKEIIKLAHERGISVEAEIGKIGENQGGGELASVEDAKAFVEAGVDKLACGIGNIHGVYPADWKGLNFDRLKEIAEAVPETPLVLHGGSGIPEDQIKKAIQLGISKVNINTEFQLAFQEATRKYIEEGKDEDKANKGYDPRKLLLPGTEAITDKMKEMIAWLGTKTIDDELKDALFDRSSLNEE

SEQ ID NO: 269 - DNA, 339 bp, Lactobacillus acidophilus
  CDS (1)...(339)
  misc_feature (0)...(0): ORF 935; histidyl tRNA synthetase
atgcttgttttagaaaagcaaaatcctgctttgtttgaatcaaatagtatcgactttttcattgctaatattggtgaaggtactgctcaaaaggcaatcgaaattactagaagtttacgtaagcaaggctttgaagcagactttgacgtcaaccaaaagaagcttaaggctcaatttaaaaaagcagaccgcgatcatgctaagtatgtaattactttaggtgaaaaggaacttgaaaatggtgtcttaaatattaagcgtttgtctgatggtaaaacaatcgatttaagtcttgaagatatcaatgatatgagtaaagtaatgggagaattaaaggac

SEQ ID NO: 270 - protein, 113 aa, Lactobacillus acidophilus
MLVLEKQNPALFESNSIDFFIANIGEGTAQKAIEITRSLRKQGFEADFDVNQKKLKAQFKKADRDHAKYVITLGEKELENGVLNIKRLSDGKTIDLSLEDINDMSKVMGELKD

SEQ ID NO: 271 - DNA, 705 bp, Lactobacillus acidophilus
  CDS (1)...(705)
  misc_feature (0)...(0): ORF 786; 30S ribosomal protein S4
ttgggcgaaaatgtaaatttaagatgcacgaatgttaaacttattcgtaatattttactccagaaattattatttaaattttatggaggatttttcatgtcaagatatacaggtccaagttggaagcgttcaagaagattaggtatctcactttcaggtactggtaaggaacttgcacgtcgtaactacgctccaggtcaacacggtcctaacagccgtggtcgtttgtcagaatatggccaacaattacacgaaaagcaaaagttacgttggatgtacggtttaaacgaacgccaatttagaactttattcattcgcgctggtaagattcgtgaaggtcaacacggtattaacttcatgatcttgcttgaacgccgtttagacagtattgtttaccgtctcggtttagctactactagagaacaagctagacaattagttaaccacggtcacatcactgttgatggcaagcgtgttgacattccttcatacgaagtcagtgttggtcaaactattggcttgaaggataagtcaaagaacttgcaacaaatcagggatgctttggaagcaactactgctcgtccatcatttgtttcatttgatgaaaacaagatggaaggtactcttgtacgtttaccagaacgtgacgaaatggaaccagaaattgacgaatcactcgttgttgaatggtacaacaagttactt

SEQ ID NO: 272 - protein, 235 aa, Lactobacillus acidophilus
MGENVNLRCTNVKLIRNILLQKLLFKFYGGFFMSRYTGPSWKRSRRLGISLSGTGKELARRNYAPGQHGPNSRGRLSEYGQQLHEKQKLRWMYGLNERQFRTLFIRAGKIREGQHGINFMILLERRLDSIVYRLGLATTREQARQLVNHGHITVDGKRVDIPSYEVSVGQTIGLKDKSKNLQQIRDALEATTARPSFVSFDENKMEGTLVRLPERDEMEPEIDESLVVEWYNKLL

SEQ ID NO: 273 - DNA, 1356 bp, Lactobacillus acidophilus
  CDS (1)...(1356)
  misc_feature (0)...(0): ORF 716; phosphoglucomutase
atgttaaaatattttggaactgatggtgttcgtggagtagctaatcaaggtttaactccagaaatggcttttaaattaggccgtgatggtggttatgttttaactaagaataaaaaagatggtgaacaagctaaggtcttagtttcacgcgacacccgtatttcaggtcaaatgcttgaatatgcacttatctcaggtcttctttccgttggtattgaagttcttgaagttggtgtaattaccactccaggtctttcatacttagttcgtgctcaaggtgcagatgcaggtattcaaatctcagcttcacacaatccagtagaggataacggtattaagttctttggtagcgatggtttgaaactttcagatgaaatggaaggcgaaattgaaaagttaattgatgctgaagaagatactttaccccgtccttctgctgaaggtcttggtactgttactgacttccatgaaggtagcgcaaaatatttacaatttatcgaaaatactattcctgaagaattagatggtatcaaagtcgttattgatggcgctaatggtgcttcaagtgcgcttatttcaagattatttgctgattgtggtgttgactttactacaatttacactcatcctaatggtttaaatattaatgatcactgtggtgctacccataccgaaaacttacaaaaagaagttgttaagcaaggtgcacaacttggtttagcttttgatggtgatgctgaccgttgtattgctgttgacgaaaatggtaacgaagttgatggtgaccacattatgtacgtaatcggttcatacttagctgaacatggtcgtcttaagaaggatactattgttactactgtaatgagtaatcttggctttacaaaggctcttgaaaaagaggatcttaagaatgttcgtactcaagtaggtgaccgttacgtttcagaagaaatgcgtgcacatggttacaatttgggtggtgaacaatcaggtcacgttattatgagcgattaccataatactggtgatggtatgcttacaggtcttcacttgatgttagtaatgaagaagactggtaaatcacttagtgaacttttgaaggatttcaaagattacccacaatgtttagtgaatgttccagttactgataaaaagagttggaaagaacatcaaccaattcttgatgtgattgctgaagttgaaaaagatatggctggcaatggtcgtgtgcttgttcgtccttcaggtacacaagatcttcttagagttatggcagaaggtccaactcaagaagaaactgatgcatatgtagatcgcattgttaaggtagtagaaaaagaaatgggtactaataaa

SEQ ID NO: 274 - protein, 452 aa, Lactobacillus acidophilus
MLKYFGTDGVRGVANQGLTPEMAFKLGRDGGYVLTKNKKDGEQAKVLVSRDTRISGQMLEYALISGLLSVGIEVLEVGVITTPGLSYLVRAQGADAGIQISASHNPVEDNGIKFFGSDGLKLSDEMEGEIEKLIDAEEDTLPRPSAEGLGTVTDFHEGSAKYLQFIENTIPEELDGIKVVIDGANGASSALISRLFADCGVDFTTIYTHPNGLNINDHCGATHTENLQKEVVKQGAQLGLAFDGDADRCIAVDENGNEVDGDHIMYVIGSYLAEHGRLKKDTIVTTVMSNLGFTKALEKEDLKNVRTQVGDRYVSEEMRAHGYNLGGEQSGHVIMSDYHNTGDGMLTGLHLMLVMKKTGKSLSELLKDFKDYPQCLVNVPVTDKKSWKEHQPILDVIAEVEKDMAGNGRVLVRPSGTQDLLRVMAEGPTQEETDAYVDRIVKVVEKEMGTNK

SEQ ID NO: 275 - DNA, 927 bp, Lactobacillus acidophilus
  CDS (1)...(927)
  misc_feature (0)...(0): ORF 1238; cysteine synthase
atgagtacaattttcaattcagtaacagaattagttggtaacacaccattattaaagttaaatcgtgttgtaccagaagatgcagcagatgtttatgtcaaattagaattcgaaaaccctgctggttcagttaaagatcgtattgctctggcaatgattgaaaaagctgaacgtgatggcaaattaaagaaaggtggcactattgtagaacctacctcgggtaatactggcattggtctagcaatggtagctgctgctaaagggtatcatattattattataatgcccgaaacaatgagtgttgaacgtcgcaagcttatgaaaggttatggagctgaactaattttaactcctggttctgacggaatgaagggctctattgctaaagccgaggagttagttaaagaaaaaggctatttcatgccaatgcaatttgataatcctgaaaatcctaacatccatgaattaaccacggggcctgaaattatcgctgcaatgaacggtattggtaaagctattgacgcctttgtagctggtgttggtactggaggtacattgtcaggtatcggtcgtgctttaaaaaaagaaaatcctaataccaaagtttacgcattagagccaagtgaatctccattactaaaagatagaaaagctggtaaacatggcatccaaggtatttctgctggttttattccaagcaatctagataaaaatatttatgatggtgtcattgaagtttcaactgacgaagctatgaatactgctcgtaaaaccgcaaaaaaagaaggcttcttacctggtatttctgctggtgctaacgttcatggggcaattgaattagctaaaaaattaggaaaaggtcacactgttgtaactgttattccagatggtggcgatcgttacctttcaaccgcactttttaatgat

SEQ ID NO: 276 - protein, 309 aa, Lactobacillus acidophilus
MSTIFNSVTELVGNTPLLKLNRVVPEDAADVYVKLEFENPAGSVKDRIALAMIEKAERDGKLKKGGTIVEPTSGNTGIGLAMVAAAKGYHIIIIMPETMSVERRKLMKGYGAELILTPGSDGMKGSIAKAEELVKEKGYFMPMQFDNPENPNIHELTTGPEIIAAMNGIGKAIDAFVAGVGTGGTLSGIGRALKKENPNTKVYALEPSESPLLKDRKAGKHGIQGISAGFIPSNLDKNIYDGVIEVSTDEAMNTARKTAKKEGFLPGISAGANVHGAIELAKKLGKGHTVVTVIPDGGDRYLSTALFND

SEQ ID NO: 277 - DNA, 726 bp, Lactobacillus acidophilus
  CDS (1)...(726)
  misc_feature (0)...(0): ORF 733
atgtcaggacattcaaaatggcacaatattcaaggccgcaagaatgcgcaagacgcaaagagaggtaaagttttccaaaagttatctcgtgaaatttatatggctgcaaagagtggtggtcctgatcctgatgggaatcctgcattacgtatggtaattgataaggcacgctcaaacaacatgcctaaagacaatatccaacgtgcgatcaagaaggccgaaggtggctcagatgaacactacgacgaaatcacttatgaaggttacgctccaggtggtgtagcagtatttgttgaagctttgactgataacaagaaccgtactgcttcagatgttcgtgttgctttcactcgtaatggtggttcacttggtgctactggttcagttgcttacatgttcgaccgtaaaggttacattgtaattgatcgttcaactactgatgctgatgaagatcaagttttacttgatgttatggacgctggtggtgatgaccttcaaactagtgatgatgcatacgaaatttatactgatcctaagcaatttgcagaagttcgtgatgcacttattaaagctggttacaagctcgctgatgctgaattgactatgattccacaaaacaccactccagttccagcagataagaaggaacaatttgaacacttagttgaagcacttgaagatagtgatgatgttcaaaatgtttatactgcagcagctgatgaagat

SEQ ID NO: 278 - protein, 242 aa, Lactobacillus acidophilus
MSGHSKWHNIQGRKNAQDAKRGKVFQKLSREIYMAAKSGGPDPDGNPALRMVIDKARSNNMPKDNIQRAIKKAEGGSDEHYDEITYEGYAPGGVAVFVEALTDNKNRTASDVRVAFTRNGGSLGATGSVAYMFDRKGYIVIDRSTTDADEDQVLLDVMDAGGDDLQTSDDAYEIYTDPKQFAEVRDALIKAGYKLADAELTMIPQNTTPVPADKKEQFEHLVEALEDSDDVQNVYTAAADED

SEQ ID NO: 279 - DNA, 438 bp, Lactobacillus acidophilus
  CDS (1)...(438)
  misc_feature (0)...(0): ORF 779; ATP synthase epsilon subunit
atggcagatccagagaaactttttaaagtaattgttgtaactcctaatggaatgatttattctcatcgtggaagcattgttgatgtacgtgctattgatggtgaacgttcaatcttatataatcacattccaattttgactccacttgcaattagtgaagtcaaggttaaacgaagtcgtgagatgggatctagaattgatcatatagccattagtggtggttatattgagttttccaataacgttgcaactattgttgctgatagtgctgaacgtgctagaaatattgatgtgtctcgtgcacaagccgctaaggaacgtgccgagaaacgtttaagagaagcgcgtgagaagcatgatgagcgtaatttggaacgagcacaagttgctttgaaacgagcaatgaaccgaattagtgtttacaacgctagaggtcat

SEQ ID NO: 280 - protein, 146 aa, Lactobacillus acidophilus
MADPEKLFKVIVVTPNGMIYSHRGSIVDVRAIDGERSILYNHIPILTPLAISEVKVKRSREMGSRIDHIAISGGYIEFSNNVATIVADSAERARNIDVSRAQAAKERAEKRLREAREKHDERNLERAQVALKRAMNRISVYNARGH

SEQ ID NO: 281 - DNA, 1326 bp, Lactobacillus acidophilus
  CDS (1)...(1326)
  misc_feature (0)...(0): ORF 846; Trigger factor cell division
atgtctgtaaaatgggaaaaaaccggtaagacaaccggtgaacttacttttgatatttcaaaagatgaaattaaattaggtttagaccaagcttttaaaagaataaagaaaaatttacgtgttcctggctttagaaagggtcacgtttctcgtgttatttttgatcaatattacggtgaagaagctttatacgaagatgctttgaatatcgtattgccaaacgcatatgcagctgctgttaaggaagctggtattaatgcagttggccaaccacaaattgttcctgtatcaatggacaaggacaaggactggactatgaaggctactgttactgtacaaccagaagttgaattaggcgaatacaagggtattgaagttcctaagcaaaacactcgtgtttaccaaaaggatattgatgctgaacttgacaagcgtcgtgaacaaagtgctgaacttgttcttaagaagggtaaggcagaaaatggcgatactgtaactatcgattacaaaggtactattgatggtaaggaatttgacggtggctcagctgaaaactactcactcgaattaggttcaggtacttttattccaggttttgaagatcaacttgttggtcacgaagctggcgatgatgttgacgttgtagtaactttccctaaagactacggtgcaaaggacttggctggtaaggaagcacactttgctactaagatccatgaagttaagtcaaagcaacttcctgaattagatgatgagtttgctaaagacgttgacgattcagtagatactcttgatgaattaaaggaaaagatcaagaaagatttaaaggatcaaaaagaacaagttgcaaatgatgctattcaagaagctgcaatcgaaggtgctgtaaagaatgctaccatcgatgaaattcctgatgctatgatccaagaagatgttgatactcaattaaatcaatacttgggtaacatgcaacgtcaaggtattgacccacaaacttactacaagttgactaatactactgaagatcaattacgttcacaatttgctaagaatgctgcagaaagagttaagactaacttagttcttgaagcaatcgttgctgcagaagatcttaaggcaactaaggaagaaattgataaggaaatcaaggaccttgctgctgaatacaacatggatgaaaaggttgtacgtaacaccttgtcagacgatatgttgggtcatgacattactgtacgtaaggctatggatcttattactgacaatgctaagcaagttgctaagtcaaaacttgaagcaaaagattcagacgataaagaaagcaag

SEQ ID NO: 282 - protein, 442 aa, Lactobacillus acidophilus
MSVKWEKTGKTTGELTFDISKDEIKLGLDQAFKRIKKNLRVPGFRKGHVSRVIFDQYYGEEALYEDALNIVLPNAYAAAVKEAGINAVGQPQIVPVSMDKDKDWTMKATVTVQPEVELGEYKGIEVPKQNTRVYQKDIDAELDKRREQSAELVLKKGKAENGDTVTIDYKGTIDGKEFDGGSAENYSLELGSGTFIPGFEDQLVGHEAGDDVDVVVTFPKDYGAKDLAGKEAHFATKIHEVKSKQLPELDDEFAKDVDDSVDTLDELKEKIKKDLKDQKEQVANDAIQEAAIEGAVKNATIDEIPDAMIQEDVDTQLNQYLGNMQRQGIDPQTYYKLTNTTEDQLRSQFAKNAAERVKTNLVLEAIVAAEDLKATKEEIDKEIKDLAAEYNMDEKVVRNTLSDDMLGHDITVRKAMDLITDNAKQVAKSKLEAKDSDDKESK

SEQ ID NO: 283 - DNA, 2757 bp, Lactobacillus acidophilus
  CDS (1)...(2757)
  misc_feature (0)...(0): ORF 654; Cation transport ATPase
atggatgaaaagaaaatccgcaaactatatgctcaaaataatattaaagatgtttttattaatttgcattcttctgttgatggcttatcacaagacgaggctgataagcgattaaagaaatacggtcttaatgaaataaaaaaggcagcagcagaatcagaatggcgcacttttttaaaaaactttactagtatgatggcaattttactctggatttcaggtttgattgctattgtatcagggacacttgagctaggaatcgccatttggctagttaatgtgattaatggtttatttagtttctggcaagagcgtgctgctaagcgtgctactgatgctttgaataacatgttaccaacgtatgttgacgtgattcgtgatggtaagaaaaaacagattgatagtaaagaacttgtccctggggatgtctttgtattacgagcaggaaattccattccagcagatgcgagaataatttctgctagttcgatgcaagttgatcaaagtgccttaaatggagaatctgttcctgaatctaagacaactaaatatgatccaggagaaggtagttatgctgagagtaatttggtttattctggaactacagttggagcaggaacggctagagcaatagcttttgctactggcatgaacacagaatttggacgtattgctagtttaacacaaaagcagactaagacaattagtccattgacggcagaattgaatcgtttaactaagcaaatttcaattattgctattacaattggcgtgttattttttattgcagcgattttcttcgttaaatatccattagctaaggcttttatttttgcactagggatgattgtcgcttttattccagaagggctacttccaaccgtaactttaagcttagctcaaggtgttaaaagaatggccaagaaacatgctttagttaaagaattaaattctgttgaaactttaggcgaaaccacagttatttgttcagataaaactggtactctaactcaaaatcagatgacaattcattatatttggacaccggctggtgaatatcaagttacaggaaatggatatgttaacaacggccaagtagaattaaaacaaaaacaactatggtatgaagaaaatcctgatttacataaattagtacaaattgctgcattggacaatgatacgtcagttcaatcagctaaagaaggtggtaaacctaaaatattaggtacgccaactgaagcggctttaactataatggcacaaaaagccggttttgataaacaaaaagttataattaaatatccacgcttaagagaattaccgtttgattctgatcgtaaaagaatgtcaacgattcatcattggaatgatactcaatatattatttttactaagggttcttatagtgacacgattaaagaatgcaatcgaattcaaatcaatggtaaagttcgtaaaatgaccgatgaagatcgagcacgtgcccaaaaagctaatgctgaatatgctgcacgtggtttacgcagtatggcattagcctatcgaattattgatcatgatgttgatatcaataagattagtattgaggatgcagaaaaggacttgatctttgtaggtttgggtacaatgagtgatccaccacgtcctgaaatttatgatgctgttaaacggtgccatcaagcaaaaattagaatcatcatggtaactggagattctaaattaactgctaaatcagtagctgttcaaattggtttgacctctgataaggctcgcgttatttcaggaactgaacttgaaacaatgagtaatgaagaattacgtaaagctttaaaaggcgaagtcatttttgctcgtgttgctcccgaacaaaagtatcggatagtgaaaaactgccaggcaaatggtgaagttgttgcttcaaccggtgacggtgttaacgatgcacccgcattaaagcaagctgatattggtattgcaatgggaaaaacaggtactgatgttgctaaggaagcagctaacatgattttgacagacgacaactttgcctcaatcgtagctgcgattgaagaagggcgtgcagtttacagtaatatccgtaaattcttaacctatatcttgacttcaaatgtaccagaagctattccatcggttttgtttcttttttcagctggattaatcccattacctatgacagtaatgcaaattttaactgtagatttagggacagatatgcttcctgctctggggttaggagcagaacctgccgatccagatgtaatgaagcagcctcctcgtaaaagatcagaacatttattaaataagagtgtcatgctcagagctttttgttggtatggcttattatctagtgtgatttcgactgcagcttacttttttgttaactggcaaaatggctggccaacaaaagctttggctgcaagtggtccaatatatatgagagcaactactatggttttaggtgcaattgtctttactcaagttgctaatgtattgaattgtcgtactaataaagtatctatattcaaaaaaggattatttagtaataaaaatatttggtacggtataatttttgaaatttgtttattctttgttttaacaataattccaggcattaataacattttcaatactgtgccgctgaatggggtagactggttgtttctcttccttcttcctattccgctagttctattagatgaagtaagaaagtggttaatgtattacaacaaaaatattaat

SEQ ID NO: 284 - protein, 919 aa, Lactobacillus acidophilus
MDEKKIRKLYAQNNIKDVFINLHSSVDGLSQDEADKRLKKYGLNEIKKAAAESEWRTFLKNFTSMMAILLWISGLIAIVSGTLELGIAIWLVNVINGLFSFWQERAAKRATDALNNMLPTYVDVIRDGKKKQIDSKELVPGDVFVLRAGNSIPADARIISASSMQVDQSALNGESVPESKTTKYDPGEGSYAESNLVYSGTTVGAGTARAIAFATGMNTEFGRIASLTQKQTKTISPLTAELNRLTKQISIIAITIGVLFFIAAIFFVKYPLAKAFIFALGMIVAFIPEGLLPTVTLSLAQGVKRMAKKHALVKELNSVETLGETTVICSDKTGTLTQNQMTIHYIWTPAGEYQVTGNGYVNNGQVELKQKQLWYEENPDLHKLVQIAALDNDTSVQSAKEGGKPKILGTPTEAALTIMAQKAGFDKQKVIIKYPRLRELPFDSDRKRMSTIHHWNDTQYIIFTKGSYSDTIKECNRIQINGKVRKMTDEDRARAQKANAEYAARGLRSMALAYRIIDHDVDINKISIEDAEKDLIFVGLGTMSDPPRPEIYDAVKRCHQAKIRIIMVTGDSKLTAKSVAVQIGLTSDKARVISGTELETMSNEELRKALKGEVIFARVAPEQKYRIVKNCQANGEVVASTGDGVNDAPALKQADIGIAMGKTGTDVAKEAANMILTDDNFASIVAAIEEGRAVYSNIRKFLTYILTSNVPEAIPSVLFLFSAGLIPLPMTVMQILTVDLGTDMLPALGLGAEPADPDVMKQPPRKRSEHLLNKSVMLRAFCWYGLLSSVISTAAYFFVNWQNGWPTKALAASGPIYMRATTMVLGAIVFTQVANVLNCRTNKVSIFKKGLFSNKNIWYGIIFEICLFFVLTIIPGINNIFNTVPLNGVDWLFLFLLPIPLVLLDEVRKWLMYYNKNIN

SEQ ID NO: 285 - DNA, 309 bp, Lactobacillus acidophilus
  CDS (1)...(309)
  misc_feature (0)...(0): ORF 422; thioredoxin reductase
atggttgaagcaattaatgaccaaaattttgaagaagaaactaatagtggcgtagccttaattgatttttgggcaacttggtgtggtccatgtaagatgcaatcaccagtaattgaacaattagctgaagaacgtcaagatgtaaaattttacaagatggatgtagatcaaaatcaagatactgctaagaatttaggaattatggctatcccaactttgattatcaaaaaagacggtaacattgttgatcgtattactggttacactccaaaggaaaaattaaaccaaattttagatcaatatgctaac

SEQ ID NO: 286 - protein, 103 aa, Lactobacillus acidophilus
MVEAINDQNFEEETNSGVALIDFWATWCGPCKMQSPVIEQLAEERQDVKFYKMDVDQNQDTAKNLGIMAIPTLIIKKDGNIVDRITGYTPKEKLNQILDQYAN

SEQ ID NO: 287 - DNA, 318 bp, Lactobacillus acidophilus
  CDS (1)...(318)
  misc_feature (0)...(0): ORF 1581; thioredoxin
atggaaaagattaaagagttatctgaagataaattacaagaaatcactaagtctggtcgcaccgttttagaattttcagcagaatggtgcccagattgccgtttccttgatccatttttgccagaaattgaaaaagatttctctgacgccaagttttatcaaattgaccgtgatggttcagttgatgttgcaaaaaaattaatgattatgggaattccttcatttgttgcctaccaagatggcaaagaaattggtagactagtaaataaggaccgtaaaactaaagatgaagtagaaaactttttacgatcacttgac

SEQ ID NO: 288 - protein, 106 aa, Lactobacillus acidophilus
MEKIKELSEDKLQEITKSGRTVLEFSAEWCPDCRFLDPFLPEIEKDFSDAKFYQIDRDGSVDVAKKLMIMGIPSFVAYQDGKEIGRLVNKDRKTKDEVENFLRSLD

SEQ ID NO: 289 - DNA, 918 bp, Lactobacillus acidophilus
  CDS (1)...(918)
  misc_feature (0)...(0): ORF 1418; oxidoreductase
atgaagagcagcggcaacaaggcaattatgcagattgctgatactggtcgtgaggcgagtggtcgcgtagccctttatggcaagcctgtatatgctccaactgctatggacttcccatttttaccgtataaagtacatgaatatagcgatgagcaaatccataatgtgataaaaggctttggtagagccgttaaacgtgcagttaaagccggatttgatggtgtagaaatccatggtgcaaaccattacttgatccagcaattcttctcagcttattcaaatcagcgaacagatcattggggtggcagtttggaaaagagaatgaacttcccgcttgctgtagttgaatctgtcgtaaatgccgttaagaagtatgcacccaaggactttattgtgggctaccgcattagtcctgaagaaatcaatccaaatagtgttggctacacttggcatgagtcgacgcaattgattaaggcaattacagataaatttgatcttgattatatttacttatctttgccagcttatgatcaaaagccagaggatagtgacaagacttttgcggaattgtttaggcctgttttaggcgaaggcaccaaggaaattattgttggtggtgttgatagtcctcaaaaggctagggatgcaatgaagtacactgacttagtagcggttggacgtgaaaatatcattgatccattatttgccgaaaagattctgactggtcatgaagatgaaatcatcgataaaattacgattgagcagactaagaaaaatggtatgactcaaggaatgattgacaatttttcagcagccagagttggcaatccacttacaggtgatgaaaatattaaatcactccacacaaagccaggtgcctggtctgaaatgacttatgttgatagtgatgaaatgaag

SEQ ID NO: 290 - protein, 306 aa, Lactobacillus acidophilus
MKSSGNKAIMQIADTGREASGRVALYGKPVYAPTAMDFPFLPYKVHEYSDEQIHNVIKGFGRAVKRAVKAGFDGVEIHGANHYLIQQFFSAYSNQRTDHWGGSLEKRMNFPLAVVESVVNAVKKYAPKDFIVGYRISPEEINPNSVGYTWHESTQLIKAITDKFDLDYIYLSLPAYDQKPEDSDKTFAELFRPVLGEGTKEIIVGGVDSPQKARDAMKYTDLVAVGRENIIDPLFAEKILTGHEDEIIDKITIEQTKKNGMTQGMIDNFSAARVGNPLTGDENIKSLHTKPGAWSEMTYVDSDEMK

SEQ ID NO: 291 - DNA, 171 bp, Lactobacillus acidophilus
  CDS (1)...(171)
  misc_feature (0)...(0): ORF 1421; oxidoreductase
atggctgaattaaacgattctttgacttttaaacatggcgcaaaaatctctaaccgcttcgttcaaccgccgatgttgacaaacagtggtatcgatggcgaagcaagtgaagacacaattaattattggagacatcactcaaagtcgggtggtatgttaattactgaatgt

SEQ ID NO: 292 - protein, 57 aa, Lactobacillus acidophilus
MAELNDSLTFKHGAKISNRFVQPPMLTNSGIDGEASEDTINYWRHHSKSGGMLITEC

SEQ ID NO: 293 - DNA, 486 bp, Lactobacillus acidophilus
  CDS (1)...(486)
  misc_feature (0)...(0): ORF 887; Nitroreductase
atggtaaattcaatttttacaaaaagaagagctactaggcaatttttaactaattcaatttctgatgataagattcaaaagattgttgcagcttttcaaacttcaccatgtggaatgcatcaaaatgacgttatgaatttagttgttgtaaaagatgaagctttacgcaaagaaatcgaaaaagcaacagataattcatgttatggtgcaccagtactatttattattaataccaagaaggagaatatgtttggtgaacgtgatgcatcagttgcagctgaaaatattatgctagaagctgctgatttaggattaggctctgtttatgttatgggtggagcaattaagttaaatgattatactgatattcaacgagagttagatatagatcctgacttccaaactacagttgttgttcctgtaggtaagattgcaagagaaccagaaaaagaagatcgttcaagtcgctatcaagtaactatttat

SEQ ID NO: 294 - protein, 162 aa, Lactobacillus acidophilus
MVNSIFTKRRATRQFLTNSISDDKIQKIVAAFQTSPCGMHQNDVMNLVVVKDEALRKEIEKATDNSCYGAPVLFIINTKKENMFGERDASVAAENIMLEAADLGLGSVYVMGGAIKLNDYTDIQRELDIDPDFQTTVVVPVGKIAREPEKEDRSSRYQVTIY

SEQ ID NO: 295 - DNA, 1089 bp, Lactobacillus acidophilus
  CDS (1)...(1089)
  misc_feature (0)...(0): ORF 666; recA
atggccaaagatgaaaaaaaggctgctttagatgcagcgctcaaaaaaatcgaaaagaatttcggtaaaggtgctgtcatgcgcatgggtgaaaaagcagacacacaaatttctacagttcccacaggttctcttgctttagatgctgctattggcgttggtggataccctcgcggccgaattatcgaagtttatggtcccgaatcatctggtaagactactgtagcacttcatgctgttgctgaagtacaaaagcgtggaggcaccgctgcgtatattgatgcagaaaatgcgatggatccagcttatgccgaggcacttggagtagatattgattcacttatcttgtctcaacctaataccggtgaagaaggtttgcaaattgctgatactttaatttctagtggtgctattgatattgtggtagttgactcagttgctgcgttagtaccacgtgctgaaattgaaggagaaatgggtgatgctcatgtaggtcttcaggctagacttatgagtcaagctttacgtaagctttccggtaccatttctaagactaagacaattgcgatttttattaatcagattcgtgaaaaagtcggtgttatgtttggtaatccggaaacaacaccgggtggtcgagcacttaagttctattcaactgttcgtcttgaagtaagaagagctgaacaaattaagcaatcaggcgatgttttaggtaaccgagtaaaaattaaagtggtaaaaaacaaggttgctccaccatttaaggtcgcagaagtagatatcatgtatggtaaaggtatttctcaaagtggcgaattacttgacatggctgcggataaggatattatcgataaagctggatcatggtattcatataagagcgatcgaattggtcaaggccgtgaaaatgctaagaagtatcttgaggaacatccagatatttatcaaaaagttcaagagcaagtacgtcaagcatatggtattgatgaaaaatccattgctgatcgtgaaaatcctgaaaaaataaaggaaaaacgtgaagaaacttcagaagaaaataagactgataattctgaaaagacaaaa

SEQ ID NO: 296 - protein, 363 aa, Lactobacillus acidophilus
MAKDEKKAALDAALKKIEKNFGKGAVMRMGEKADTQISTVPTGSLALDAAIGVGGYPRGRIIEVYGPESSGKTTVALHAVAEVQKRGGTAAYIDAENAMDPAYAEALGVDIDSLILSQPNTGEEGLQIADTLISSGAIDIVVVDSVAALVPRAEIEGEMGDAHVGLQARLMSQALRKLSGTISKTKTIAIFINQIREKVGVMFGNPETTPGGRALKFYSTVRLEVRRAEQIKQSGDVLGNRVKIKVVKNKVAPPFKVAEVDIMYGKGISQSGELLDMAADKDIIDKAGSWYSYKSDRIGQGRENAKKYLEEHPDIYQKVQEQVRQAYGIDEKSIADRENPEKIKEKREETSEENKTDNSEKTK

SEQ ID NO: 297 - DNA, 651 bp, Lactobacillus acidophilus
  CDS (1)...(651)
  misc_feature (0)...(0): ORF 1969; flpA
atgaagaaacattcaccaattggctgtattagtaaggcgggtttattttcaaagttaccacataaaatgcttgaaaaaatagctccgatttctacacatcaagaatattttgaaaaaggtagctttatccgtcagccgggcgatggtaagaatggaatgatgttcgtagacaaaggtagtgctaaaatctataatttaaatcgtgatggtaaagaaactgtcttaggagttttgaataaaggtgactatgatggacaacagaatttatttcaagatgatagtcatgagaattttattcaagctttgcaggatacttatatttgttccattagtcgcgctgactttcaaaggctgcttaaggatacaccagatttaactttaaacttgcttaataactttggtgagaaattagtagcaatagaaactaattcagttcgcagaaattcaatgaatgctaaagatcgtttaatggattatttagttgaacaaagtcaaaagaatggagcgactaaatttactttacctttgaaaaagaaagatttagcgagttatttgggaacaagccctgagactttaagtaggcagttaaaatcattggaaaaagaaggaaaaataaaagtcaatcgtcgagaaatcaccattgttaaggac

SEQ ID NO: 298 - protein, 217 aa, Lactobacillus acidophilus
MKKHSPIGCISKAGLFSKLPHKMLEKIAPISTHQEYFEKGSFIRQPGDGKNGMMFVDKGSAKIYNLNRDGKETVLGVLNKGDYDGQQNLFQDDSHENFIQALQDTYICSISRADFQRLLKDTPDLTLNLLNNFGEKLVAIETNSVRRNSMNAKDRLMDYLVEQSQKNGATKFTLPLKKKDLASYLGTSPETLSRQLKSLEKEGKIKVNRREITIVKD

SEQ ID NO: 299 - DNA, 633 bp, Lactobacillus acidophilus
  CDS (1)...(633)
  misc_feature (0)...(0): ORF 544; transcriptional regulator
atggctgatttatgtgttaacttagtaccactatttgatgctttacctcaggatgagaagatgcaaatcgaaaaattagttcagcataaaaactatcaaaagggtgaagtgataattgatccaacgataaatgataatttagtaattgtagctgatggtaacgctaagcagtacaccttagatgaagacggctatgagaatgttttgcaaatcttgcatacaggtgattatattggtgaggattggctttttggtcaaaaaaatatcaataattacgtcgaggctacggaacacagtgaaatttgtttattaaagcggcaggatctactgaagctgatgcataaacagccagaattaagtattcgattattggaactaagtattgttaaagtttcggaaatgcaaaaacaaattcacttgatggctttgccgaaggttgaagaccggttattaaagtatttacaaacatatgcagatgaaattggtaaaaataattttaccttacccttaaaaatgaaggacttagccttataccttggaacaacacctgagaccctgtctcgtaaatttgctttattagaaaagcaaggtcaactgaaacgtcaattacgtcgaattgaattattcgaaaat

SEQ ID NO: 300 - protein, 211 aa, Lactobacillus acidophilus
MADLCVNLVPLFDALPQDEKMQIEKLVQHKNYQKGEVIIDPTINDNLVIVADGNAKQYTLDEDGYENVLQILHTGDYIGEDWLFGQKNINNYVEATEHSEICLLKRQDLLKLMHKQPELSIRLLELSIVKVSEMQKQIHLMALPKVEDRLLKYLQTYADEIGKNNFTLPLKMKDLALYLGTTPETLSRKFALLEKQGQLKRQLRRIELFEN

SEQ ID NO: 301 - DNA, 201 bp, Lactobacillus acidophilus
  CDS (1)...(201)
  misc_feature (0)...(0): ORF 818; Cold shock protein
atgcgtttaggtactgttaagcaatttgatgacggtagcagttatggctttattgaagatgataaaaatcataaatcatactttgttttttataaggccattaaagaagaaggctataaatcattgcgagttggtgaccgagttaaatatcaattagctcaaggaaaaaatggcttacaatgtgtcaatgtatatttagcc

SEQ ID NO: 302 - protein, 67 aa, Lactobacillus acidophilus
MRLGTVKQFDDGSSYGFIEDDKNHKSYFVFYKAIKEEGYKSLRVGDRVKYQLAQGKNGLQCVNVYLA

SEQ ID NO: 303 - DNA, 423 bp, Lactobacillus acidophilus
  CDS (1)...(423)
  misc_feature (0)...(0): ORF 205; heat shock protein
atggcaaacgatatgatgaatcgtcgcaatgatatgatggatgcaatgaacgattggtttggttttccaagaaacttctttgatgacagcgaaattgaaaatatcatgcaatcagatgttgcagaaactgataaggactatgtagttaagattgatatgcccggcatgaataaagacgacatcaaacttaattacaaagatggcgttttaagcgtggccggtactagaaaagcctttaaagatactaacgataaggaaagaaatatcatccacaaagaaagaagcgaaggtagtatctcaagaagctatagattgccaaatgtagttgcaaatgagattcatgcaaagtatgataatggtgtattaaccatcaccctaccaaagcaaactgctggggatgatgataattctatccagattgat

SEQ ID NO: 304 - protein, 141 aa, Lactobacillus acidophilus
MANDMMNRRNDMMDAMNDWFGFPRNFFDDSEIENIMQSDVAETDKDYVVKIDMPGMNKDDIKLNYKDGVLSVAGTRKAFKDTNDKERNIIHKERSEGSISRSYRLPNVVANEIHAKYDNGVLTITLPKQTAGDDDNSIQID

SEQ ID NO: 305 - DNA, 2154 bp, Lactobacillus acidophilus
  CDS (1)...(2154)
  misc_feature (0)...(0): ORF 278;  FtsH  Cell division protein
atgaagaataaccggaatcggctgctttcaaacggccttttctatatagttgtgttccttctgctcctatggggaatcaactgggcactaggcggctctaacaatagcggtagttcagaaaatattagctactcacaatttgttaaagatttgcgtcaaggcaaagttaaaaactttagtgttcaacctgctaatggtgtttacactgtttcaggtagttacaagactgcacaaacagcaaagaatcaatcaaatagtagttttgatttctttagtaataattcaagtagaaaagtatccagcttctctacaaccatgttacaaaatgattctaccgtttcgaatgtgcaaaacttggcacaaaagagtaacgctcggatgacaactcaaggagaatcacaatctggcaattggatttcaactattgtcatgcttgtaccaactgttttgtttattgtcatgctttggatgatgatgaatcaaagcggtgctggacgtggtggtagcggcggaataatgaattttggtcgttcacatgtcaaaccagaagatccttctaaaaataaggttcgtttctctgacgtagccggtgaagaagaagaaaagcaagaattagtcgaagttgttgaatttttgaaagatccatcaaaatacactaagttgggtgcgagaatcccatctggtgttttacttgagggccctcctggtactggtaagaccttacttgctcgtgctgtagcgggtgaagccaacgtaccattttactcaatttcaggttcagacttcgttgaaatgtttgtcggtgttggtgcaagtcgtgtacgtgatttatttagcaatgctaagaagaatgcaccaagtatcatctttatcgatgaaattgatgctattggtcgtcgtcgtggaaatggtaccggtggtggaaacgatgaacgtgaacaaacgttaaatcaattattggttgaaatggatggttttgaaggcgatgaaggtgtaatcgttattgccgcaactaatcgttcagatgtcttggatccagctttacttcgtccaggtcgttttgaccgtaaggtattagttggtcgtcctgatgttcgcggtcgtgaagctatcttaaaagttcatgctaagaataagccacttgctcctgatgttgacttaaaagaagtagctcgtcaaactccaggttttgtaggtgcggatttagctaatgttttaaatgaagctgcattggtagctgctcgtagaaacggtactgaaattaccgcgtcagatattgatgaagctgaggatcgtgtaattgctgggccagctaagaaggatcgtctaattgcagaaccagaaagacgtcgagttgcttttcacgaagcaggtcactcaatctgtggtttggtattgagcgattcaagaactgtacgtaaggtaactattgtgcctcgtggtcgtgctggtggatataacatcatgcttccaaaggatgatcaattcatcttaactaagaatcaattatttgaacaaattgttggtttaatgggtggtcgtgctggtgaagaagcaactattggtgataaatcaactggtgcttcaaacgactttgaacaagctacacaaattgctcatagtatggttgttaactatggtatgactgaatctctgggtatggttgagcttgaaaaagaaggcgaaagtaatccttatggattcaaaccttacagtgaggcaactgctgctaagattgatgaagcggttaagaaaatcttggatgaagctcatgctaaagcccttgaaatcgtaaaagaaaacaaggaaaagcacagaattattgctgaagctttacttaaatatgaaactttagatgaaaagcaaatcatgtccttatataagactggtaagatgcctgaaaaggatgaaactgaatatccaagtgaatcaaaagcttcaacttacgaagaagctaaggctgctgcagaaaaacgtgaagttgaaaaagcagaaaagaaagactcagatcaagctttagctgatcaagaaaaagatgctttggaaactccattagaaaagaatcatgaagtcgaagaacataatcccgaaaatcctgaaaaggacgaaaagactaattcaaataatgattcatctgcagacgatgagcaaaga

SEQ ID NO: 306 - protein, 718 aa, Lactobacillus acidophilus
MKNNRNRLLSNGLFYIVVFLLLLWGINWALGGSNNSGSSENISYSQFVKDLRQGKVKNFSVQPANGVYTVSGSYKTAQTAKNQSNSSFDFFSNNSSRKVSSFSTTMLQNDSTVSNVQNLAQKSNARMTTQGESQSGNWISTIVMLVPTVLFIVMLWMMMNQSGAGRGGSGGIMNFGRSHVKPEDPSKNKVRFSDVAGEEEEKQELVEVVEFLKDPSKYTKLGARIPSGVLLEGPPGTGKTLLARAVAGEANVPFYSISGSDFVEMFVGVGASRVRDLFSNAKKNAPSIIFIDEIDAIGRRRGNGTGGGNDEREQTLNQLLVEMDGFEGDEGVIVIAATNRSDVLDPALLRPGRFDRKVLVGRPDVRGREAILKVHAKNKPLAPDVDLKEVARQTPGFVGADLANVLNEAALVAARRNGTEITASDIDEAEDRVIAGPAKKDRLIAEPERRRVAFHEAGHSICGLVLSDSRTVRKVTIVPRGRAGGYNIMLPKDDQFILTKNQLFEQIVGLMGGRAGEEATIGDKSTGASNDFEQATQIAHSMVVNYGMTESLGMVELEKEGESNPYGFKPYSEATAAKIDEAVKKILDEAHAKALEIVKENKEKHRIIAEALLKYETLDEKQIMSLYKTGKMPEKDETEYPSESKASTYEEAKAAAEKREVEKAEKKDSDQALADQEKDALETPLEKNHEVEEHNPENPEKDEKTNSNNDSSADDEQR

SEQ ID NO: 307 - DNA, 924 bp, Lactobacillus acidophilus
  CDS (1)...(924)
  misc_feature (0)...(0): ORF 679; Thioredoxin reductase general stress protein 35/EC 1.6.4.5
atggccgataaatatgacgtaattgtaattggcgctggaccaggtggtatgacagcggctttatatgctacccgtgctaatttaaatgtattggtgcttgatcgtggaccatacggtggtcaaatgaacaatactgatgcaattgataattatccaggctttactgaagttaaaggaccagaacttagtcaaaagatgtatgatactttaatgaagtttgaacctgattataaatacggtaatgtacaatcagttgaattagatggagacgaaaaagttattaagactgacgatgaagaatatcgcgctccagtcttaattatcgctactggtgcagatcatagacacttgaatgttccaggtgaagaggaatactcaggtagaggagtttcttattgtgctgtttgtgatgctgcattttttaaggatgaagatgtggttgtagtgggtggcggtgattccgctatcgaagaaggaatttatctttctcaaatggccaagagcgtaactgttattcaccgtcgtgatcaattacgtgctcagcctactttgcaaaaacgtgcatttgcaaatgaaaaaatgaagttcatttggaatgctcaaacagaagaaattctaggtgatggtaatcgtgtaaccggtgttaagtatctagataaagaaaatggagaaactaaagaagtttctgctgcaggtgtatttatttatgtgggtgtgttaccacaaactgaaccatttaaaaaactaggtattttaaatgaacaaggttggattccaactaatgagcacatggaaacaaaagtatcaggtatttttgctttaggtgatgttcgtgataaagatttgcgtcaaattgctaatgcggttggtgaaggtagtgtagcggggcaggctgcatataattattttcaagatttaaaaaac

SEQ ID NO: 308 - protein, 308 aa, Lactobacillus acidophilus
MADKYDVIVIGAGPGGMTAALYATRANLNVLVLDRGPYGGQMNNTDAIDNYPGFTEVKGPELSQKMYDTLMKFEPDYKYGNVQSVELDGDEKVIKTDDEEYRAPVLIIATGADHRHLNVPGEEEYSGRGVSYCAVCDAAFFKDEDVVVVGGGDSAIEEGIYLSQMAKSVTVIHRRDQLRAQPTLQKRAFANEKMKFIWNAQTEEILGDGNRVTGVKYLDKENGETKEVSAAGVFIYVGVLPQTEPFKKLGILNEQGWIPTNEHMETKVSGIFALGDVRDKDLRQIANAVGEGSVAGQAAYNYFQDLKN

SEQ ID NO: 309 - DNA, 1182 bp, Lactobacillus acidophilus
  CDS (1)...(1182)
  misc_feature (0)...(0): ORF 833; FtsW- Cell division protein
gtgcgtcgaaaattaagatatcttaattaccgaattttaatcccatacttaattttagtagttgtaggaataattttggtatattcagcaagttcagacattttattagttaatggatttaagccagatgtttatggaattcgtcaagcaatctatgctgctgtagcattttttggatttggtattcctttttttgcattaaggctaaaggttattaaaaatccaaaatttgtagctggttttttaataatctgtattttaatgctgctatggttggtctttttaagatttgctcatggtagtgcagcagccgttaatggggctgttggttggattaacttgggtttcattaatcttcagccgttagaagttactaaattggctttagtaatttatttagcttatgttttggatcgaagagacggaaaattagtaaggggaaaaattaaagataatctatctcatcctgctatgctagctggtttcttaatgtgtttagttattgtagagcctgactttggtggtaccgcaattttattcatgattacgttagtaatgttttccgtatctggtgtaccagttaggttagcactaacttggctactcggaatcatactattagttggggcagtttttattttagtagttctttggaatcctaaatttttgcaggatagttatcaatttcaacgattgatgtcatttttacatccctttcaacttgaaagaaaaggtggagcccaattagttaattcttactatgcaatccataatggaggattgtttggtgtaggattagggaacagtatgcaaaaacgaggatatttgccagaaccatatactgattttattttatctattacagccgaagaaattggcgttatcttcacgattgtactggttggtctattattttatttaatgtggcaaattatggaagtaggtattaatgccgtctcacaatttgatgcattaatttgctttggcgtgacaacaattatttttactgaagcattgtttaatatcggtgctgtattaggtctattaccaattactggtgttacgctgccatttatttcgtatggtggttcttctatgatcgttttaactgctgcaattgggttagtgctgaatgtatctgctaatgaaaaaatgttaaaagaaaaggatgaaacaattgca

SEQ ID NO: 310 - protein, 394 aa, Lactobacillus acidophilus
MRRKLRYLNYRILIPYLILVVVGIILVYSASSDILLVNGFKPDVYGIRQAIYAAVAFFGFGIPFFALRLKVIKNPKFVAGFLIICILMLLWLVFLRFAHGSAAAVNGAVGWINLGFINLQPLEVTKLALVIYLAYVLDRRDGKLVRGKIKDNLSHPAMLAGFLMCLVIVEPDFGGTAILFMITLVMFSVSGVPVRLALTWLLGIILLVGAVFILVVLWNPKFLQDSYQFQRLMSFLHPFQLERKGGAQLVNSYYAIHNGGLFGVGLGNSMQKRGYLPEPYTDFILSITAEEIGVIFTIVLVGLLFYLMWQIMEVGINAVSQFDALICFGVTTIIFTEALFNIGAVLGLLPITGVTLPFISYGGSSMIVLTAAIGLVLNVSANEKMLKEKDETIA

SEQ ID NO: 311 - DNA, 1305 bp, Lactobacillus acidophilus
  CDS (1)...(1305)
  misc_feature (0)...(0): ORF 851;  LysA - Diaminopimelate decarboxylase/EC 4.1.1.20
atgaatccacaaattatggaaaaacaagttaatgaaaaagggcatttaacaattggcggtgttgatactcttgaacttgcgaagaaatatggtacgccgttagttgtatatgatgtaaatcgaatccgtaatcaaattagggcttttaaaaaagtatttgaagaagaaggcgttagttatgctgtgagttatgctagcaaagcatttgcctgtattgctatgtatcaagtagccaatgaagaaggtgcatatactgatgttgtttcggctggagaattgtatactgcattgaaagccggctttccagcagaaaaaattagttttcatggtaataataaatctttagctgaaattgaaatggcagttaaaaatcatgtaggaaagattattattgataattttcatgagattgaactgctagatcaggtattgcaccaatatgatacccaaataaatgttatgttgcgaatcactccaggaatttcggcacatactcatgaatatgatcaaaccggtcaaattgatagtaaatttggctttgatctagaatcaggacaggcagatttagcattagagcgagttttagctaattcgagaatgaatatgttaggtattcatgctcatataggatcacaaatttttgaattaaatggttttgaattagctgctaaaaagttaatggaagtagcagaaaattggcgtagccaatatggatatacagcaaaaataattaatgtaggtggcggttttggcatcaaatatactgctgatgataatccgttaaaacctgaagaattcgtaagaacaattattgaaacaataaaaaaaggatcagctgatgctgcttttccaactccagaaattgatattgaacctggtcgttcaattgtaggtcctgctggatataacttatatactgtgggaagttgtaaaactattccaagttatagtccatatgttgccgtagatggtggtatgggtgacaatattcgtcctgcgttatatcaagcaaaatatgatgtggttttagcaaataatcctaaggcgccagtcgttaatcgcgtgaggatcgcaggtaaatattgtgagagtggcgatattttagctaccgaatcattaccagaagttaaatctggtgacgtactagcaatgctggatacaggagcatacggatattcaatggcgtcgaattataatcgaaatcctcgaccagctgtagtttttgcagaaaacagaaaagcgcacttagtcgtcaaaagagaaagtttagaagatctagttcatttagacaggttttgtaaggaa

SEQ ID NO: 312 - protein, 435 aa, Lactobacillus acidophilus
MNPQIMEKQVNEKGHLTIGGVDTLELAKKYGTPLVVYDVNRIRNQIRAFKKVFEEEGVSYAVSYASKAFACIAMYQVANEEGAYTDVVSAGELYTALKAGFPAEKISFHGNNKSLAEIEMAVKNHVGKIIIDNFHEIELLDQVLHQYDTQINVMLRITPGISAHTHEYDQTGQIDSKFGFDLESGQADLALERVLANSRMNMLGIHAHIGSQIFELNGFELAAKKLMEVAENWRSQYGYTAKIINVGGGFGIKYTADDNPLKPEEFVRTIIETIKKGSADAAFPTPEIDIEPGRSIVGPAGYNLYTVGSCKTIPSYSPYVAVDGGMGDNIRPALYQAKYDVVLANNPKAPVVNRVRIAGKYCESGDILATESLPEVKSGDVLAMLDTGAYGYSMASNYNRNPRPAVVFAENRKAHLVVKRESLEDLVHLDRFCKE

SEQ ID NO: 313 - DNA, 2238 bp, Lactobacillus acidophilus
  CDS (1)...(2238)
  misc_feature (0)...(0): ORF 932;  RelA ppGpp synthetase/involved in starvation response/EC 2.7.6.5
atgtctaaatatgttgaaatgacgcatgatcaagtaattgatacttgtaaaaagtatatgaatgaagatcaagttgcctttgttgaaagagcatatgaatttgctaataaagctcatgctggacaaaagcgggcatccggacaaccttatattattcacccaactcaagttgctggtacattagccaatttaggacttgatccagatacgattgccgctggttttttacatgataccgtagaagatacgccagtaactaatgatgaattaaaagaaaaatttggtgaggatgttgctttcatcgtcgatggtgtaactaagctaaataagtatgaatataattctcaccaagaatttttagctgaaaatcaccgtaaaatgttgattgcaatggctaaagatttacgagttattatggttaaattagctgaccgtttgcataatatgcatactttacaacatttgcgtcctgataagcaaagacgaattgcttcagaaacgatggatatttatgcaccattagctgatcgtttaggtatcggaacaattaagtgggaattagaagatatgagtttccactacttaaatcctgaagcatattaccgtattgttaacttaatggatgtcaaaagaagtcaacgtgagaaatatatttctgatactattaagactttgaagaaaacacttgatgagttgggaattaaatacgatatttatggtcgaccaaagcatatttattctatctataaaaagatggtaaataagcataaggactttgatgaaatttatgatttgcttgcagttcgtgtaattgttaaaaacgttcgtgattgttatgctgttttgggtgctgttcatactgaatggaaaccaatgccaggtagatttaaagattatattgcgatgcctaaggtcaacggatatcaatcacttcatactacgattattggaccaggtggtcgtccacttgaaattcagattaggaccgagcaaatgcatgaagttgctgaatacggtgttgctgctcactgggcatataagcgtggtaatttcaatggggttgaagcaacgtcgtcaggtgaaaagctggatatggttcgtgaaattctagaattaaaggatgagactaaggacgccggcgagttcatgaagtcagttaaaagtgatatcttttctgatcgtgtgtatgtctttactccaaaaggtgaggtatatgaattgcctaagggatcagttacattagattttgcttatgcaattcatactcaagtaggtagtcatgccgttggtgctagagtaaataataaattagtaccacttgattataaattaagaaatggcgatgtaattgagattatgacgcagaccaatgcggctccatcacgtgattgggcggatatggttaagacgtcaagagctcgtaacaagattcgtcgttactttagaggtcaagaccgtgaagaaagtatcgagcatggtgagcaaatggtggctaataccattcgtgatgaaggactcgtgccgaaagacttcatggataaagagcatattgaaaaattacttgaacattttaattacaatacttctgaagagttatacgcagcagtaggttttggtgatctgtcagcacaagcggttgttaatagattaacaattgatttgcgtcgtgaagatgaaaaacaaaagcaaaaagaactagaagaaaagattttgaattctggtcagcaggcaattaaagaagaacaacctaagaaaaattcaaattctgtcatgaaagttaagcataagaatggagtaatgattcaaggcgttagtgatttaatgctccatttagctaaatgttgtaatccggttcctggagatgaaattattggttacgtcactaaaggacgtggagtgactattcaccgaacagattgtagaaatataactaaggaagcggaagaacaaggtcgattgattgatgttgaatgggagaacgttgaagaaaacaatgttcaatcatttaatgcaaatattgaggtctttggctataatcgttctaatttgcttagcgatgtaatcaataaattgaactcattaactaaaaatattaataatatttctggtaaagttaatgatgataacattgcgcatatttatgtgactgttgctgttagaaatgcaaagcaacttgatgaaattttaagcaaattgcgtgatattcctgatgtatatgaaacaaagaggtcagacaat

SEQ ID NO: 314 - protein, 746 aa, Lactobacillus acidophilus
MSKYVEMTHDQVIDTCKKYMNEDQVAFVERAYEFANKAHAGQKRASGQPYIIHPTQVAGTLANLGLDPDTIAAGFLHDTVEDTPVTNDELKEKFGEDVAFIVDGVTKLNKYEYNSHQEFLAENHRKMLIAMAKDLRVIMVKLADRLHNMHTLQHLRPDKQRRIASETMDIYAPLADRLGIGTIKWELEDMSFHYLNPEAYYRIVNLMDVKRSQREKYISDTIKTLKKTLDELGIKYDIYGRPKHIYSIYKKMVNKHKDFDEIYDLLAVRVIVKNVRDCYAVLGAVHTEWKPMPGRFKDYIAMPKVNGYQSLHTTIIGPGGRPLEIQIRTEQMHEVAEYGVAAHWAYKRGNFNGVEATSSGEKLDMVREILELKDETKDAGEFMKSVKSDIFSDRVYVFTPKGEVYELPKGSVTLDFAYAIHTQVGSHAVGARVNNKLVPLDYKLRNGDVIEIMTQTNAAPSRDWADMVKTSRARNKIRRYFRGQDREESIEHGEQMVANTIRDEGLVPKDFMDKEHIEKLLEHFNYNTSEELYAAVGFGDLSAQAVVNRLTIDLRREDEKQKQKELEEKILNSGQQAIKEEQPKKNSNSVMKVKHKNGVMIQGVSDLMLHLAKCCNPVPGDEIIGYVTKGRGVTIHRTDCRNITKEAEEQGRLIDVEWENVEENNVQSFNANIEVFGYNRSNLLSDVINKLNSLTKNINNISGKVNDDNIAHIYVTVAVRNAKQLDEILSKLRDIPDVYETKRSDN

SEQ ID NO: 315 - DNA, 1470 bp, Lactobacillus acidophilus
  CDS (1)...(1470)
  misc_feature (0)...(0): ORF 995; Amino Acid Permease
atgtcagaagaaattgaaactattaatttcgaacccggcaaaaagcattatatgagttggccagtcattgctttgattgactttgttactattattagttttgaaaatattttttatccatttcaaaaccaaggattatccgttgttgtttcttggatcttccttttatttgcttatgttattccttatgctttgatgtgtagtcaaatggggttgacttttaaagatcaagcaggtggacttgcttcttgggttcgtcattcatcaaatgatactttaggttattggacctcttggatgtattgggtacaaaccgtcccttatctagttgacgtatccaattcagttattgtttcattctcttggattattttaggcaataatactttagacaagcacatgtctactttctggttcggaatcttaacatttgtaattattttggcttttatcctgatagaaaatgctattaagaactcacttgagcttctttctttaatcggtgggggtgccatgttcattatgtctatgctgtttgtcttacttgcagcttgggccgttatgcatggtcatcatattgctactcagccatttaacttaagtgcatttaaaccatcgtttagtttgagatatttctcaactactggtttattgatttttgctatgtctggtgctgaacttgctgcgccttacattgtacaaatgcgagatccaaaacacgaatttcctaaagcaatgtggatgctagctattatgactggctttttaaccatctttggtactttagcattagcactcttctttaatgctcaccatattccacacgactttaagatgaacggaccttactatgctttccaacttttaggggaaagtttaggctggggtaaagtcttaatgtacatctttgccgtcgttcaagccatctttatgatggcacaattagccgtgttactagatgcatctagtcgtgtattcgcaggtgacgttgccgataagtacatgcctaagtggcttaccggcaaaaaggacaagacaggacgtccgatccactcttacactttgacttgtggcttggctttattcttgcttttacttactggtactttaccaaatatcaattctatttataattggttattaaacattaacggtattatttcaccatacaaaacttgttgggtattctttgcttttatcatgatgcgtatgcaccaaaagaaatttcattccgattatgtttttataaaaaatagaacgggtgccctaatcatgggttggtggtgcttaatcttcactttcatctgtgctaccttaggttttatccctcaagaagcagaagctacatttggtagtaccgcatttaatcaccaattgatcatgaatatcatcacagttaccgtactctttggattaggcttcttattgccttggctacgtagacgtgaagaaaaacgtgaaatgaatata

SEQ ID NO: 316 - protein, 490 aa, Lactobacillus acidophilus
MSEEIETINFEPGKKHYMSWPVIALIDFVTIISFENIFYPFQNQGLSVVVSWIFLLFAYVIPYALMCSQMGLTFKDQAGGLASWVRHSSNDTLGYWTSWMYWVQTVPYLVDVSNSVIVSFSWIILGNNTLDKHMSTFWFGILTFVIILAFILIENAIKNSLELLSLIGGGAMFIMSMLFVLLAAWAVMHGHHIATQPFNLSAFKPSFSLRYFSTTGLLIFAMSGAELAAPYIVQMRDPKHEFPKAMWMLAIMTGFLTIFGTLALALFFNAHHIPHDFKMNGPYYAFQLLGESLGWGKVLMYIFAVVQAIFMMAQLAVLLDASSRVFAGDVADKYMPKWLTGKKDKTGRPIHSYTLTCGLALFLLLLTGTLPNINSIYNWLLNINGIISPYKTCWVFFAFIMMRMHQKKFHSDYVFIKNRTGALIMGWWCLIFTFICATLGFIPQEAEATFGSTAFNHQLIMNIITVTVLFGLGFLLPWLRRREEKREMNI

SEQ ID NO: 317 - DNA, 1929 bp, Lactobacillus acidophilus
  CDS (1)...(1929)
  misc_feature (0)...(0): ORF 1012; Beta-glucoside specific PTS system
atgaatgaaaacaatgaaattgcaattctcgctcccgcaagcggtgaagtaattgcattaagtaaaacaagtgatccaatctttagtaaaggtgcaatgggacaaggatttggtcttacaccatctgatggtgaagttgttgcaccaataagtggaaaagtttcaatgattgcagatactaaacatgctattggaataaccacagatgatgggcttgaagtattagttcacatgggagttgatacagttagtcttaagggagagccttttgaagttttagttaaaaatggtcaaactattgaagccgggcaagatattgccacaatgaatcttaaagccattaaaagtagcaatcttgatactaccattatggttttaatcacaaactcaaatgataagcttgagggtttagacgtttctgaaggtcctgctagaactggcgacgttatagctcatgcatacctaaaagtagaacaaaagaatacctcaaatcaaaagctttcatatgatgaactggcaacttttatcataaaaaatgttgggggcaaagataatattaacaatttaattcactgtatcactcgtctacgcttctacttgaaagatgaaagtaaagctaatgacgaagcattaaagaatcaacgtggtattcttgatgttatgcatgctggtggtcaatatcaagttgttatcggaaatgaagttactaatgtttatgatgcagtaatgaaacagcttcctaatttaagtgatcaacctgctccacaaactaatgaaaatgatgaccgtaatcctgtttcaaaggcatttggcaacttgatcggctttattactggttcaatgagtccagtaattggcgtaatcgctgcatcaggtattattaaaggatttttggctttactcactcttccacaacttggagcattattaaacgttaaaagtcctgtctatataacagttagtgcaatggctgactcagcattcttcttcctaccaattttagttggattctcggctgctaaacgacttaatagtgatccaattattgcagctgtaattggtggttttattacttatccccaaatgattagttggggtactgcgggtaagatgatgtttaatctaggtaattggaacttccaattcttaaactacagttactcaatctttccaatgatcttggctgcatggcttgctgctaaatgcgaagattggcttaagaaaattttaccaagctatttacaaatgattttcgtaccattaattactattttagctgtatcaaccatcactttagtaattacggggccagttattcaaggtgctgctaacggcatcgcagtatttattaattggttagtatcatcatcaggttggatcggcggcttagtaatcggtgccttttaccaactacttgttatcttcggtcttcactggggtgttgtaccactggtcgctcaacaaattgcttctactggtcaaagttcattaaatgcaattatttgttcaactatgatcgctcaaggtgctgccgttttagctgttgcagttaagtcaaagaaggctgacatgaaagaattaggtattgcagctgctatctcagcattctgcggtgttaccgaaccagcgatttatggaattaacttaagatacaagaaagtttttgcttcaggctgtgtcggttcagcatttggtggtcttgtaaccggtcttatgcatggtacaatgtacggttttactggtggtctaattggattttctagtttcttcaatccggctcatcctactcaactaaacagtttctacacattcttaatcgctagtgctgtttctattgtggttgcattcattgttacctgggtttggggctataatgataatatgaccatgggtaaaaaagttgaaaagaaacaacgtccaggtactaag

SEQ ID NO: 318 - protein, 643 aa, Lactobacillus acidophilus
MNENNEIAILAPASGEVIALSKTSDPIFSKGAMGQGFGLTPSDGEVVAPISGKVSMIADTKHAIGITTDDGLEVLVHMGVDTVSLKGEPFEVLVKNGQTIEAGQDIATMNLKAIKSSNLDTTIMVLITNSNDKLEGLDVSEGPARTGDVIAHAYLKVEQKNTSNQKLSYDELATFIIKNVGGKDNINNLIHCITRLRFYLKDESKANDEALKNQRGILDVMHAGGQYQVVIGNEVTNVYDAVMKQLPNLSDQPAPQTNENDDRNPVSKAFGNLIGFITGSMSPVIGVIAASGIIKGFLALLTLPQLGALLNVKSPVYITVSAMADSAFFFLPILVGFSAAKRLNSDPIIAAVIGGFITYPQMISWGTAGKMMFNLGNWNFQFLNYSYSIFPMILAAWLAAKCEDWLKKILPSYLQMIFVPLITILAVSTITLVITGPVIQGAANGIAVFINWLVSSSGWIGGLVIGAFYQLLVIFGLHWGVVPLVAQQIASTGQSSLNAIICSTMIAQGAAVLAVAVKSKKADMKELGIAAAISAFCGVTEPAIYGINLRYKKVFASGCVGSAFGGLVTGLMHGTMYGFTGGLIGFSSFFNPAHPTQLNSFYTFLIASAVSIVVAFIVTWVWGYNDNMTMGKKVEKKQRPGTK

SEQ ID NO: 319 - DNA, 1662 bp, Lactobacillus acidophilus
  CDS (1)...(1662)
  misc_feature (0)...(0): ORF 1014; Trehalose 6-P hydrolase
atgattaatttaggcaaaaaaataatttatcaaatttatcctaaatctttctatgattcaaatggcgatggggtaggagatcttcaaggaatcattcaaaagattgattatattaagaagttaaatgtagacatgatctggtttaatccattttttgtttcaccgcaaaatgataatggttatgatattgctgattattacaacattgatcctcgctttggtacaatggctgattttgagaaattggtaaagaagctgaaagaaatcggtgtgggtgtaatgctagatatggtgctcaatcactgctcaactgaaaatatttggtttaaaaaagcacttgctggcaatgaaaagtatcgtaaatttttctacttgagaaaaggaaaaaacggaggtttacctaataattggcaaagtaaattcggtggtactgcttggtcaaaatttggtgataccgattactactaccttcacttgtatgatccaactcaagcagatcttgattggcataatcctgaagttcgtaaagaattatttaaagtggttaacttttggcgtagtaaaggtgtccatggcttccgctttgatgtaattaatgttacgggtaaagcggaaaaactagttgattcaacagatcctgtagaagaaaagagtttgtacactgatactccaattgttcataaatacttaaaagagcttaatgctgcaacttttggtcaagaccctgaatcaattactgtgggagaaatgtcatcaacgacgattgccaactcaattgaatattcaaaaccaagtgaacatgaattatcaatggttttcactttccatcatttgaaagttgactatcaggatggtgaaaagtggtctaagatgccatttgattttatgaaattaaaggaattattcactgaatggcaagaaaaaatggatcaaggtgatggctggaacgcattattctgggacaatcatgatcagccttgggcattaactagatttggtgatactggtaagtatcgtggaaagtcagctgaaatgcttgccacagcaactcatcttatgcggggaacaccatatatttatatgggtgaagaaattggtatgattgatcctgattattcttcaatggatgattacgtagatgttgaggccaagaatgcttttaaggctttaactaaaaaaggtttgagtgataaagaagcttttgaaatagttaaatcaaaagctcgtgacaattcacgtgtaccaatgcattggaatagtgaaaaatatgcaggttttagtgaacataagccgtggctcataccaactgatcaagaaaaaattaatgttgaagaggaattagcacatggtgaaatttttaattactatcaaaagttaattaagctgcgtagaagcgaagatttaatctctgatggtcatattaagatgttcttgaaagatgatccgcaggtttttgcttatgaacgctacttaaaagatagtgataaaaagttattggtatttactaacttctatggtaaagaacatagtgttaaattacccgaagaatatcaaaacaaagaataccaagttttaattaacaattatgatactaaagatagccaattaaccgatgaaattatattgaagccatatgaagcattagctattaaaattaaacaa

SEQ ID NO: 320 - protein, 554 aa, Lactobacillus acidophilus
MINLGKKIIYQIYPKSFYDSNGDGVGDLQGIIQKIDYIKKLNVDMIWFNPFFVSPQNDNGYDIADYYNIDPRFGTMADFEKLVKKLKEIGVGVMLDMVLNHCSTENIWFKKALAGNEKYRKFFYLRKGKNGGLPNNWQSKFGGTAWSKFGDTDYYYLHLYDPTQADLDWHNPEVRKELFKVVNFWRSKGVHGFRFDVINVTGKAEKLVDSTDPVEEKSLYTDTPIVHKYLKELNAATFGQDPESITVGEMSSTTIANSIEYSKPSEHELSMVFTFHHLKVDYQDGEKWSKMPFDFMKLKELFTEWQEKMDQGDGWNALFWDNHDQPWALTRFGDTGKYRGKSAEMLATATHLMRGTPYIYMGEEIGMIDPDYSSMDDYVDVEAKNAFKALTKKGLSDKEAFEIVKSKARDNSRVPMHWNSEKYAGFSEHKPWLIPTDQEKINVEEELAHGEIFNYYQKLIKLRRSEDLISDGHIKMFLKDDPQVFAYERYLKDSDKKLLVFTNFYGKEHSVKLPEEYQNKEYQVLINNYDTKDSQLTDEIILKPYEALAIKIKQ

SEQ ID NO: 321 - DNA, 2631 bp, Lactobacillus acidophilus
  CDS (1)...(2631)
  misc_feature (0)...(0): ORF 1255; Translation initiation factor
atggcaaaaaaaagaatttatgaagtcgcaaaagaagtcggcgttgataataaagttgtagtccaaaaagcaaaggatttgggctttgatgtgaagaatcatatgtcgtcaatagatgattcacaagttgcgaagctaaagagtagtttccagaactccgctcctgctgaaaaaaaagcagaaaagtcagccactaagaataataaaattaagatttcagtttcttcaattcgaaaaaatgaaaagaaaccagaggaaaataatactcctaagaaatcaaatagaagacgtaataataaacgtcgttctagtgatcgagctcgggataataaagaacgtgatgcaaaatctaatacaggtagaccaaaagcagcagctttgcttcaacaatttaagcaaaagcaacgtgcagaagaaggtcagcttaatagagaagctcaaaaagcaaagaaagaatatcatgagcatttgaagcatcctaaaaaagagcagtcagaaaaagataataagaaaacagtaaaagaaagtaataacaaaaaagtagagcaacaagtggaaaagaaagtaatcggaccaaaaatcttaaaaccatcaccagcccgtttaaagaaaaatcaacctgcagataataaggaaaaagttactactcctagagtaactattcctgaagcaccaaaggaagaaaaacgtggtaacggtcgtggcagaaatatgggtaagccaggacgcaaaggaaagaatcaatttgttaatggacatagtgaacgttcagaccgttcagagagaaaacgtcgtaaaaataagaaacatcaacaggaacagcaaaagcctagaaaacaaattaccaaacgtaaggaacgtccattaccagatatattagtatatgaagaaggtatgaacgctcaagatatcggtaaattgattcaccgagaaccagctgaaattgttaagaaattattcatgcttggtgttatgactaatcaaaaccaatcattggataaagatactattgaacttttagctgctgaatatggtattgatgctaagcaaaaagttcatgaagatatttctgatattgatactctttacgacaagagaatggaagcttcaaagaagtctaaaaaccaaattaagcgcccacctgtagttactattatgggtcacgttgaccatggtaaaacgactttgttggaccgtcttcgtcatactcacgtttcagctcatgaagctggtggcattactcaaagaatcggtgcttaccaagttagacttgacgatcgtttgattacattcttagatactccaggacatgctgccttttctaatatgcgtgcacgtggtgctgaaattactgatattgttgtattggttgtagctgcggatgatggtgtaatgcctcagactgttgaagctattgaccacgctaagagtgctaatgttccaatcattgttgctattaacaagatggacaagccaggtgctaacccacaacacgtaactgaagaattaatgaagtataatttaattcctgaagattacggtggtgacacaattttcgttaacatttcagctaagacaggtcaaaatgtagatgatttattgcaaatgatcttacttcaagctgacgtgatggaacttaaggctaacccagatgaaatggcaatcggtactgtaattgaagcacgtttgtcacgtggtcgtggtccagttgccgacgttttgatccaacaaggtacacttaatattggtgatccgattgttgtaggtgatacttttggtcgtgtacgtactatgactaacgatcgtggtcgccaagttaagaaggctacaccatcagagcctgttgaaattactggtttgaatgatgtgcctgaatctgctgacaagttagttgaatttaaggacgaaaagactgcaagaagtgttggtgaagctagagctcaacaatcattgcaaaagtctcgtgaaaatgttcaacatgtaactcttgataacctcttcgatactatgaagaaggaaaacatgaaggaagttgacattgttcttaaggcagatgttcaaggttcagtagaagcattgcaacaatcacttgaaaagattgaagttgaaggtgttcgtgtaaacattatccactcaggtgtaggtgcaattaatgaatcagatgtaactttagctggtgcatctaatgcctttattattggatttaatgttcgtccaactgctactgcaaaaagtcaagcagaaactgacggtgtagatattcgtttatacagtatcatttacaaggctattgatgatgttaccgctgccatgaagggtatgcttgaacctacttatgaagaaaaggttattggtaatcttactgttcgtgaaacttggaaggtttcaaaggttggtacaattgccggatcatttgttgataaaggtatagtcaagaatgattctaaaattagagttattcgtgacggtattgttaagtatgacggtgaaattgcctcacttaagagattcaaggatgacgttaaagaagttaaacaaggtaatgactgcggtttaactattaaggattacaacgatattaaagtcggcgacgaattcgaagtatacgaaatgcaacaagttgaacctaag

SEQ ID NO: 322 - protein, 877 aa, Lactobacillus acidophilus
MAKKRIYEVAKEVGVDNKVVVQKAKDLGFDVKNHMSSIDDSQVAKLKSSFQNSAPAEKKAEKSATKNNKIKISVSSIRKNEKKPEENNTPKKSNRRRNNKRRSSDRARDNKERDAKSNTGRPKAAALLQQFKQKQRAEEGQLNREAQKAKKEYHEHLKHPKKEQSEKDNKKTVKESNNKKVEQQVEKKVIGPKILKPSPARLKKNQPADNKEKVTTPRVTIPEAPKEEKRGNGRGRNMGKPGRKGKNQFVNGHSERSDRSERKRRKNKKHQQEQQKPRKQITKRKERPLPDILVYEEGMNAQDIGKLIHREPAEIVKKLFMLGVMTNQNQSLDKDTIELLAAEYGIDAKQKVHEDISDIDTLYDKRMEASKKSKNQIKRPPVVTIMGHVDHGKTTLLDRLRHTHVSAHEAGGITQRIGAYQVRLDDRLITFLDTPGHAAFSNMRARGAEITDIVVLVVAADDGVMPQTVEAIDHAKSANVPIIVAINKMDKPGANPQHVTEELMKYNLIPEDYGGDTIFVNISAKTGQNVDDLLQMILLQADVMELKANPDEMAIGTVIEARLSRGRGPVADVLIQQGTLNIGDPIVVGDTFGRVRTMTNDRGRQVKKATPSEPVEITGLNDVPESADKLVEFKDEKTARSVGEARAQQSLQKSRENVQHVTLDNLFDTMKKENMKEVDIVLKADVQGSVEALQQSLEKIEVEGVRVNIIHSGVGAINESDVTLAGASNAFIIGFNVRPTATAKSQAETDGVDIRLYSIIYKAIDDVTAAMKGMLEPTYEEKVIGNLTVRETWKVSKVGTIAGSFVDKGIVKNDSKIRVIRDGIVKYDGEIASLKRFKDDVKEVKQGNDCGLTIKDYNDIKVGDEFEVYEMQQVEPK

SEQ ID NO: 323 - DNA, 1167 bp, Lactobacillus acidophilus
  CDS (1)...(1167)
  misc_feature (0)...(0): ORF 1259; N-utilization substance protein A
atgtctaaagaaatgctagaagcgttcgctacattggaaaagaacaagggcattgaacaagatgttattgttgatgcaattaaggccgctttggtagctgcatacaagaaaaattataatcaagcacaaaacgttgaagttgattttgatgagagaaaaggcaattttaaagttatggcagttaagactgttgttgatgaagttcaagatgatcgccttgaagttagcttaaaagatgctttggcaatcaaccgtgcttatgaagtaggcgatgaaattcgttttgaagttactccaaagaattttggtcgtattgctgctcaaactgcaaagcaagtaattatgcaacgtcttcgtgaagctgaaagaaatcatattattgatgaatattctcaatacgaagatgaacttgtcactggtacagttgaaagacgcgacaatcgttttgtctatgtgaagattggtaacgttgaagcagtaatgcctcatcgtgatcaaatgccaaatgaagtttataacccacaagatcaaattcgtgtgcttgtaactcatgttggctcagattctaagggagcacaaatcactgtttcaagaactgcaccagatatggtaaagcgcttgtttgaacaagaagttcctgaaatttacgatggaactgttgaaattgtttcaatcgcgcgcgaagctggtgaccgtacaaagatggcagttaagtcaaatgaccctaatattgaccctgttggtacttgcgttggtcaaaagggtgcacgtgtacaaaatgtagttaatgaacttggtggagaaaatattgatattgtaaaatatgaagaagatccatctgactatattgctaatgcattgaatcctgctgaagtaattgctgttcaatttggcgaagacgaggaggaaaagagtgcgttagttattgtcccagattaccaattatcacttgctattggtaaaaaaggacaaaacgtacgtcttgcagctcgtttaacaggctataaaattgatattcgaccagagtctgaagtagaatttgttgatgaaaagtcaactgattctgtaagtaaagaagatacagattcttctgaagatgttgtatctactgaagaatcaactgctgatgtaactactgaagaaaaaagcgaagataacactgaagaa

SEQ ID NO: 324 - protein, 389 aa, Lactobacillus acidophilus
MSKEMLEAFATLEKNKGIEQDVIVDAIKAALVAAYKKNYNQAQNVEVDFDERKGNFKVMAVKTVVDEVQDDRLEVSLKDALAINRAYEVGDEIRFEVTPKNFGRIAAQTAKQVIMQRLREAERNHIIDEYSQYEDELVTGTVERRDNRFVYVKIGNVEAVMPHRDQMPNEVYNPQDQIRVLVTHVGSDSKGAQITVSRTAPDMVKRLFEQEVPEIYDGTVEIVSIAREAGDRTKMAVKSNDPNIDPVGTCVGQKGARVQNVVNELGGENIDIVKYEEDPSDYIANALNPAEVIAVQFGEDEEEKSALVIVPDYQLSLAIGKKGQNVRLAARLTGYKIDIRPESEVEFVDEKSTDSVSKEDTDSSEDVVSTEESTADVTTEEKSEDNTEE

SEQ ID NO: 325 - DNA, 474 bp, Lactobacillus acidophilus
  CDS (1)...(474)
  misc_feature (0)...(0): ORF 1260
ttgtctaaagttgtaaatcttgttcgtccagttgtcgaatcaattattgatgaacatggcgacatgttagtcaatatggaatatattaaagaaaaaagtcagaattatttacgtatttatgttgatcgtgaaccaaatggtattgatattgatgaaattgcagttttaagtgaactgatttctgaaaagttagatacacttgatccagatccacttcctgacccatatgttttagaattatcgtctccaggtgcagaacgtccaattaaaactaaagcagactgggaaaaagcactgaacgattatattcatgttggtctttatcaaaagatagaagataaaaagatgtacgaaggtacacttaaatcttataatgatgatgagattatattagaagtaaaagataagacaagacgaaaaacattaactgttccccgtaagttaattgcaaatattcgttttgcaattgagttt

SEQ ID NO: 326 - protein, 158 aa, Lactobacillus acidophilus
MSKVVNLVRPVVESIIDEHGDMLVNMEYIKEKSQNYLRIYVDREPNGIDIDEIAVLSELISEKLDTLDPDPLPDPYVLELSSPGAERPIKTKADWEKALNDYIHVGLYQKIEDKKMYEGTLKSYNDDEIILEVKDKTRRKTLTVPRKLIANIRFAIEF

SEQ ID NO: 327 - DNA, 1254 bp, Lactobacillus acidophilus
  CDS (1)...(1254)
  misc_feature (0)...(0): ORF 1263; Eep determinant for enhanced expression of pheromone
ttgaagggtatactaatctttttagttgtctttggcttacttgtttttgttcatgaatttggacacttcattgtagctaaaaagtcaggaattcttgtgcgagaattctcaattggtatgggcccaaaactattccaaattagacgaaatcccaccacttataccattcgttggttaccacttggtgggtatgttcgtttagcgggctctgatgatgaaagtaaattagatccgggtatgactgtagtcttacagttaaatgataaaaatgaagtgattagaattgatgcttctgaatcagatattccgatcgaggggattcccgttcaagtcactaaagctgatttagtggatgatttaataatcgaaggttatgagaatggcgatgaaaatgatccagtaacttatcatgtaaatcatgatgctaccattattgaaaaaaatggtactgaattaattatcgctccacgtgatacgcaatttaatcaggctaatgtctggcaaaaacttgcaactaattttgcaggaccttttatgaatattgtcttaggatttgtagtgttcttaatttggacttttacagttccaggtcctgcaactacaactgtaggctctgtccaaacagattcgccagcgcgtagtgctaagatcgaatctggtgatagaatagttgcaataaatgatcaaaacatcactaattttgatcaagtatcagaaaaaataaatcaaagtaagggtaagagcttacgttttaaattggaaaagaatggttctactagaactatttctgttaagccaaaagcacataaagtgcaaaatcagactgtctatcaagtcggtattgttgctaaaagtaacgaaaatgcaggcgtaaaattgaagagaggctgggacacagcagtttctactactggtttaatttttaatgccgtaggtaatttatttagtcatttcagtttaaataagttatcaggtccagtgggaatttattctcaaacttctcaagtttctcagatgggctttacttatgtattagcattcttggggatgatttcaattaatctgggaattgtaaatttaattcctattccaggattagacggtggtaagcttttattgaacttgatcgaattaattcgcggtaaggcaatctctgaagaacacgaagcgattgttgaattaattggctttggtttattattagtattaattattgcagttacaggtaacgatatttatcgctattttattaaa

SEQ ID NO: 328 - protein, 418 aa, Lactobacillus acidophilus
MKGILIFLVVFGLLVFVHEFGHFIVAKKSGILVREFSIGMGPKLFQIRRNPTTYTIRWLPLGGYVRLAGSDDESKLDPGMTVVLQLNDKNEVIRIDASESDIPIEGIPVQVTKADLVDDLIIEGYENGDENDPVTYHVNHDATIIEKNGTELIIAPRDTQFNQANVWQKLATNFAGPFMNIVLGFVVFLIWTFTVPGPATTTVGSVQTDSPARSAKIESGDRIVAINDQNITNFDQVSEKINQSKGKSLRFKLEKNGSTRTISVKPKAHKVQNQTVYQVGIVAKSNENAGVKLKRGWDTAVSTTGLIFNAVGNLFSHFSLNKLSGPVGIYSQTSQVSQMGFTYVLAFLGMISINLGIVNLIPIPGLDGGKLLLNLIELIRGKAISEEHEAIVELIGFGLLLVLIIAVTGNDIYRYFIK

SEQ ID NO: 329 - DNA, 345 bp, Lactobacillus acidophilus
  CDS (1)...(345)
  misc_feature (0)...(0): ORF 1286; 50S ribosomal protein
atggatccattaattcaagaattaactaaagaacaaattcgtgacgatattcctgcattccgtgcaggtgacactgttactgttcacgtacgtgttgttgaaggtactcacgaacgtatccaattgttcgaaggtgttgtaattaagaagaagggtactggcatcggtgctacttacactgttcgtaagattgcttcaggtgttggtgttgaaagaactttcccagttaacgacccacgtgttgctaaggttgaagttaagcgtcatggtcgtgtacgtcgcgctaagctttactacttacgtgaacgtcacggtaagtcagcaagaattgctgaagcacgtcgt

SEQ ID NO: 330 - protein, 115 aa, Lactobacillus acidophilus
MDPLIQELTKEQIRDDIPAFRAGDTVTVHVRVVEGTHERIQLFEGVVIKKKGTGIGATYTVRKIASGVGVERTFPVNDPRVAKVEVKRHGRVRRAKLYYLRERHGKSARIAEARR

SEQ ID NO: 331 - DNA, 513 bp, Lactobacillus acidophilus
  CDS (1)...(513)
  misc_feature (0)...(0): ORF 1288; 16S rRNA processing protein
atgcagtactttgatgttgcacgaattttgactacacatggattacatggagaagttaaagtaaatgtgattacggattttccagaagatagatttgctgaggggatgcaactagaattaaaagatgatattgatcgagttttaacaataaaaaagagtagaccatttaagcaattttggctacttcaatttgatgaaataactgatattgatgaagctgaaaaattacgtggaaaaattttagtaattagtgaaaaagatcgtggtgaattaccagatggagtttactattacaaggatatttttgattgtggtgtaatagacaatgagactggtaaaagattaggtaaaataactgatattcaatcacctggtgctaacgatatttggcttgtgcatgaagacaatggtaaagaatattggattcctaatattgctgatgttgtaaagaaaatagatattgctgataaaaaggtatatgttgaattgatggagggattgcgagatgaagat

SEQ ID NO: 332 - protein, 171 aa, Lactobacillus acidophilus
MQYFDVARILTTHGLHGEVKVNVITDFPEDRFAEGMQLELKDDIDRVLTIKKSRPFKQFWLLQFDEITDIDEAEKLRGKILVISEKDRGELPDGVYYYKDIFDCGVIDNETGKRLGKITDIQSPGANDIWLVHEDNGKEYWIPNIADVVKKIDIADKKVYVELMEGLRDED

SEQ ID NO: 333 - DNA, 339 bp, Lactobacillus acidophilus
  CDS (1)...(339)
  misc_feature (0)...(0): ORF 1291; Amino acid transporter
atggatgaattgacaaaaaatgaagagcttggagatttatatgcatattacggctctttgcttactaagggacaacaatcttattttgaagattattattataatgatttatctttaggagaaattgctattaatcatcatgtatcacgtcaggccgtttatgataatctaaagcgatcaagtaaaagtttacaaaactatgaagaaaaacttcatatgcgtaaagataataattatattgaaaatattttaactagtgtgctatcgtcattgaataataacgacgataaagctgctaaaaatgaaataacgaatttattaaataaattgaggggagag

SEQ ID NO: 334 - protein, 113 aa, Lactobacillus acidophilus
MDELTKNEELGDLYAYYGSLLTKGQQSYFEDYYYNDLSLGEIAINHHVSRQAVYDNLKRSSKSLQNYEEKLHMRKDNNYIENILTSVLSSLNNNDDKAAKNEITNLLNKLRGE

SEQ ID NO: 335 - DNA, 1425 bp, Lactobacillus acidophilus
  CDS (1)...(1425)
  misc_feature (0)...(0): ORF 1292; amino acid transporter
gtgaatctttggcaaaaaatgaacaagaaagaagatccacgcgtctatgaaaataaagatggacacctggttcgctcattgaaagttaaggactttttagccttaggtgttggaacaatagtttctgcttctatctttactttacctggtgaagtagcagcattgcacaccggtccagctgtggcaatttcatttattttagcagctgtcgcagccggacttgttgcatttgcatacgcagaaatggctgctgcaatgccctttgcgggatctgcttattcatggattaatgtggttttcggtgaattctggggctgggttgccggatgggcgcttctagcagaatactttattgctctagcctttgtaggatccgggctttcggctaactttagagctttaattgctccattaggaataaaattacctgcagccttatccaatgcatttggaactaacggtggggttattgatatcatttcacttatatcaattctgttagttgctcttttaatcagtcacggtgtttcaagagcagcgcgcgttgaaaatgcattagttgtattaaaagttttagcaattttattttttatcgttgttggtttaaccgcaattaagggttctaattttgtcccatttattcctaagtatcgtccaactgctcacggaccttttggtggttggcaagggatatatgctggtgtatcaatgattttcttatcctacatcggttttgattcaattgctgctaactcagccgaagcaattaatccccaaaagactatgccacgcggtatcttaggctcacttgccattgcagttacattatttgttggcgttagtcttgtattaattggtatcatgccatatcaaaaatatgctaactcagctgagcctgttggtttagctcttcgttatgcaggacatcctattgtagctattgttgttcaaactattgctgttcttggaatgttcactgccttaatcggaatgagtatggcaggttcaagattgatttattcatttggtcgagatggtatgcttcctaaatggctaggtaaattaaatgctgatcgtcgtcctaacaatgctttatggactttaacagttattggtatcttacttggggcattcttcccattctctatgctgtctcaattagtttcagcaggtacccttatcgcatttatgttcgtatcactgggaatttataaattacgtcctcgtgaaggtaaagacattgatgatccttcatttaagatgccattttatccagtattaccagcattaggtttcttagccgcattagtcgtattcttgggattagattatcaagccaaactttatgccggtatctggtttattctaggattgcttatttacttaggatatggtgtacaccactctgttttaaacaataaaaaa

SEQ ID NO: 336 - protein, 475 aa, Lactobacillus acidophilus
MNLWQKMNKKEDPRVYENKDGHLVRSLKVKDFLALGVGTIVSASIFTLPGEVAALHTGPAVAISFILAAVAAGLVAFAYAEMAAAMPFAGSAYSWINVVFGEFWGWVAGWALLAEYFIALAFVGSGLSANFRALIAPLGIKLPAALSNAFGTNGGVIDIISLISILLVALLISHGVSRAARVENALVVLKVLAILFFIVVGLTAIKGSNFVPFIPKYRPTAHGPFGGWQGIYAGVSMIFLSYIGFDSIAANSAEAINPQKTMPRGILGSLAIAVTLFVGVSLVLIGIMPYQKYANSAEPVGLALRYAGHPIVAIVVQTIAVLGMFTALIGMSMAGSRLIYSFGRDGMLPKWLGKLNADRRPNNALWTLTVIGILLGAFFPFSMLSQLVSAGTLIAFMFVSLGIYKLRPREGKDIDDPSFKMPFYPVLPALGFLAALVVFLGLDYQAKLYAGIWFILGLLIYLGYGVHHSVLNNKK

SEQ ID NO: 337 - DNA, 1419 bp, Lactobacillus acidophilus
  CDS (1)...(1419)
  misc_feature (0)...(0): ORF 1294; dipeptidase
atgaaagaatatagtgcttgtactaccatcttagttggtaaaaatgcctcaattgatggcacaactatgattgctcgtaatgatgataccttccgcccaattactccacaaaagtttattattgagccagctcgtcatggcgaaaagaaacatattaaatcatggcttaataagtttgagatggatcttccagaagatgcacaacgagttcctgccgtaccaaatgttgattataaacatcgtggttactacgatgaaagtggtattaaccaagaaaatgttgctatgtcatgtactgaatcaacttatggtaatgaaagaactttagcatttgatccattggttaaagatggattagatgaagactgtatgcaaaccgtagttttgccatacattcattcagcacgtgatggtgttaagtatttaggtaagttaattgctaagtatggctcaccagctggtaactctgttttgttcagtgataaagatgaaatttggtacatggaaattgtaactggtcaccactgggtagcagaacgtattcctgatgattgctatgctgcaactggtaaccgtgtagctattgaacaagtcgatttcgataatcctgaatacttcatgtggagtgaaggaattcaagaatttgttgaagaacatcacttgaatccagatcatgaaggttggaatttccgtcatatctttggtacttacactgaacaagatcgccactacaatactaaccgtcaatggtatattcaaaagttgttcaacccagaaattgaacaagatccacaagatggcgatattccatttattcgtaaggcagctaagaagattaccaaggaagatattgaatttgccttaggttcacattatcaagatactccatatgatccatttggtaagggtaccgaagaagaaaagcaccgctaccgtcctattggtttgaaccgtacgcaaaatgctcatattttacaaataagaagtgatgtaccagcagaccgtgcagcaattatgtggttatgtattggtggtccaacgtttactccatttatcccattctttgctaatatgaatgaaactgatccttcatttaacaatacttcaatggattacaatatgagtgatgcatggtggtactacaagtcatttgctgcacttgttgaaagccactatccacaatttgttcaacttgatactacttatcttactgaacttaatcgttacttcagaggtcgtgttgaagaaattattaagaattcagaaggtaaatcaggcgatgaattaactgaatacttaactaaagaaaatcaaaagactgttgctcatactcgcaaggaaactgaaaagttatggggagaaatgatgattgattcaattaatatgtctaagttgacttttaatatggatgaaaatctc

SEQ ID NO: 338 - protein, 473 aa, Lactobacillus acidophilus
MKEYSACTTILVGKNASIDGTTMIARNDDTFRPITPQKFIIEPARHGEKKHIKSWLNKFEMDLPEDAQRVPAVPNVDYKHRGYYDESGINQENVAMSCTESTYGNERTLAFDPLVKDGLDEDCMQTVVLPYIHSARDGVKYLGKLIAKYGSPAGNSVLFSDKDEIWYMEIVTGHHWVAERIPDDCYAATGNRVAIEQVDFDNPEYFMWSEGIQEFVEEHHLNPDHEGWNFRHIFGTYTEQDRHYNTNRQWYIQKLFNPEIEQDPQDGDIPFIRKAAKKITKEDIEFALGSHYQDTPYDPFGKGTEEEKHRYRPIGLNRTQNAHILQIRSDVPADRAAIMWLCIGGPTFTPFIPFFANMNETDPSFNNTSMDYNMSDAWWYYKSFAALVESHYPQFVQLDTTYLTELNRYFRGRVEEIIKNSEGKSGDELTEYLTKENQKTVAHTRKETEKLWGEMMIDSINMSKLTFNMDENL

SEQ ID NO: 339 - DNA, 2082 bp, Lactobacillus acidophilus
  CDS (1)...(2082)
  misc_feature (0)...(0): ORF 1578; Serine protease
atgaaatttaataaaaaagttgtgctaatttcagccgttgctttaatgatggtgtcaccagttttgtcaatgggacaaaacttaaccaccactgttaaagccgctgatgatcaaactgaaaataatcgattatttatcggaagtgtaaagtcttatatctacaacaataagggtaagcgtactacatataagggaaaatcttctcttaagtatggttctcgcgtagattatttaggtaagttttctgattataacggtaaaaacaaatactacttcatggatactaagggctacaagaagtttgcttcttacaagattattaaaggtaaggcatacttcccaattggtaagaatgcctatgtccgtgtagttaatgtcgctcagattaacgatcgtcctctttatgcaaaatcactaagtgtcgtagttagtcctaagtatgttcaaaagcaaggtcaatatgctttcgatgcagataacaatataattaagggtgtttattttaaaccgggtaaaaaattaactattgatgcacaagaatatgttactaatggtaaccacactgataccatttatcgtgtaaaaggtactaagcaatttatttatgctaatagattaaagactgcagtaaggcaacaattagaaattttatctacccaaactcacgtcattatgaataaagatactcacatgtatcttgcaaacggtgagttaaagactaagaagcctaatacaaacgatagagtaagctatcgcaaaggccaaagaactgtggttgatcaattagtttatctttgggttcctagcgaaaacaaggctgaattattctatcgagttgaaagtggttggacgcctgctggttcagaaggatatgaaccaactactagcttgggttatgttaaggtaagcgatgttgactatgattttggcccacaaatggttgatccggataacaccgctgcagaagctgaagcaggtaaggctgtcgcaactagttcagataaggctgaacttaatagtttgattaatgaaaatcttgaagacaataatttatacaaattcagttcattaagtcaacaatggaattatgctggtgctcttcaaaatgctaaggaaattaatgattcaaagactgcaaccattaatgaagttaaccaagcagtatgggaacttaaatttactaagaatgaattaagtggtgaaaaggttaagatcgacaacttaggttggatcgataattcaactgccaataagatcgttcatacagctggtagttcttaccgtagcaatcaaaatgttagatatgcgatcgacatggtaaatcacaatactgtacttcgcttaagagaatttgcagtgcaaagtaatggctcagacactaatcatcttcttgcaactagagaacttaacatcaatgactacgttactgtaactgatccaaatccaactgaaaaagcaggctatcaaagttcactttctgaaaagaacttgacaagtaactcaactttgaagaagtatgctgatttgatcgactacaatgaattgactactaacttggttgccaaaactaatactccaatttacactaacagctataagaataactacgctaatgtaagtaaagggaatgtaaatttaaccagaactagtcaaatcatcaagaagggtaacaacattggttacaaggttggccctatcgtaagagttaagggtcaatattacgcaatggttcgtagtaagaaacgttatttctacgtaagagctgatgcaattgcccgtgataactttactaaagacgcagcttacaagaagtacagtaagatgattgacgatgctgtaacttcagaaaatagtactgttttggttactcctactcaaaacacagtaacttatgaaagaaatagttacggtgagcttggttcaagccgtccttataagaaaggcactatggcttactacatcgctgaaccacatgtaatgaaatacaatggtgaatggtacttcattagtggttatccaacttacagtggtacaacttacattgctaagactgttaagctttctaaaaatactattatgaaa

SEQ ID NO: 340 - protein, 694 aa, Lactobacillus acidophilus
MKFNKKVVLISAVALMMVSPVLSMGQNLTTTVKAADDQTENNRLFIGSVKSYIYNNKGKRTTYKGKSSLKYGSRVDYLGKFSDYNGKNKYYFMDTKGYKKFASYKIIKGKAYFPIGKNAYVRVVNVAQINDRPLYAKSLSVVVSPKYVQKQGQYAFDADNNIIKGVYFKPGKKLTIDAQEYVTNGNHTDTIYRVKGTKQFIYANRLKTAVRQQLEILSTQTHVIMNKDTHMYLANGELKTKKPNTNDRVSYRKGQRTVVDQLVYLWVPSENKAELFYRVESGWTPAGSEGYEPTTSLGYVKVSDVDYDFGPQMVDPDNTAAEAEAGKAVATSSDKAELNSLINENLEDNNLYKFSSLSQQWNYAGALQNAKEINDSKTATINEVNQAVWELKFTKNELSGEKVKIDNLGWIDNSTANKIVHTAGSSYRSNQNVRYAIDMVNHNTVLRLREFAVQSNGSDTNHLLATRELNINDYVTVTDPNPTEKAGYQSSLSEKNLTSNSTLKKYADLIDYNELTTNLVAKTNTPIYTNSYKNNYANVSKGNVNLTRTSQIIKKGNNIGYKVGPIVRVKGQYYAMVRSKKRYFYVRADAIARDNFTKDAAYKKYSKMIDDAVTSENSTVLVTPTQNTVTYERNSYGELGSSRPYKKGTMAYYIAEPHVMKYNGEWYFISGYPTYSGTTYIAKTVKLSKNTIMK

SEQ ID NO: 341 - DNA, 930 bp, Lactobacillus acidophilus
  CDS (1)...(930)
  misc_feature (0)...(0): ORF 1898; Thioredoxin reductase/EC 1.6.4.5
atgaaaaaatatgatgtagcaattattggagctgggcctggtggtatggcggctgcgttatatgcagcaagagctaatttaacggtagcaatgattgatcgaggcgtttatggcggacaaatgaacaacactgctgaggtagaaaattatccaggttttccatcgattttaggacctgagcttggagaaaagatgtatcaaaacactgttaagcaaggtgttaactttgtttatggggatgttcaagggatagaagttaaagacgacaaaagaatcgttaaattaggcagtgaagacagtgacattgaaacgaaagctgtaattattggtacaggttcgtctaatcgaaaattaggagttcccggtgaagatgaatattcgggcaaaggtgtttcctactgcgcagtttgtgatggtgctttctttaagaatgaaaatgtcgtagttgtaggtggtggtgactcagctgtttctgagggactttatttagctaacgttactgataatgtaaatgtcattcatcgacgtgatcaattacgtgctgaacaagttttacaaaaacgtgcttttaaaaatccaaagatggactttacttgggatagtgaagtaaaagaaatcattggtgacgaaaataaaatgactggtgtaaaggttcataacaagaaaactggaaaagacgagactatagatgcaaacggagcttttatttacattgggaatattccaaatagtgaaccttttagagacttaaatattactgataaagatggctggattttgactaacgatcaaatggaaactgaagtaccaggaatctttgcaatcggtgatgttcgtaaaaagaaattacgtcaaattattactgccgttaatgatggtggtattgccggtcaaaacgcttatgaatacattcaaaaacttactgaaaat

SEQ ID NO: 342 - protein, 310 aa, Lactobacillus acidophilus
MKKYDVAIIGAGPGGMAAALYAARANLTVAMIDRGVYGGQMNNTAEVENYPGFPSILGPELGEKMYQNTVKQGVNFVYGDVQGIEVKDDKRIVKLGSEDSDIETKAVIIGTGSSNRKLGVPGEDEYSGKGVSYCAVCDGAFFKNENVVVVGGGDSAVSEGLYLANVTDNVNVIHRRDQLRAEQVLQKRAFKNPKMDFTWDSEVKEIIGDENKMTGVKVHNKKTGKDETIDANGAFIYIGNIPNSEPFRDLNITDKDGWILTNDQMETEVPGIFAIGDVRKKKLRQIITAVNDGGIAGQNAYEYIQKLTEN

SEQ ID NO: 343 - DNA, 1284 bp, Lactobacillus acidophilus
  CDS (1)...(1284)
  misc_feature (0)...(0): ORF 889; 2-phosphoglycerate dehydratase
atgctcaaatcagttattgaaaatgtacacgcactcgaaatttttgactcacgtggtaacccaactgttgaagttcacgttactctttcaaacggtgtcgtaggtaaggctgaagttccatcaggtgcttcaactggtgaaaacgaagctgttgaattacgtgacggtggttcacgtcttggtggtaagggtgtttcaaaggctgttaacaatgttaacactgaaattaacgacgctttaaagggtatggacccatttgaccaacctaagattgaccaaactatgatcgacttagatggtactccaaacaagggccgtcttggtgctaacgctatcttaggtgtatcaatggctactgctgttgctgcagctaacgctaaccgtcaacctctttaccgttaccttggcggtattgatcttgaaatgccacaaactttccacaacgttatcaacggtggtgaacacgctgacaacggtatcgacattcaagaattcatgattactccaattgctaagacttcattccgtgatggtttcgaaaagatcgttaacgtataccacactttgaagaaggttcttgaagacatgggttacgaaactggcttgggtgacgaaggtggtttcgcacctaacatgaagaactcagaagaagctttgaaggctttacacgaatcaatcatcaaggctggttacaagccaggtgaagatatcggtatcgcatgtgactgtgctgcttcatacttctacaacaaggaagatggtaagtaccaccttgaaggtaaggttcttactgatgatgaattagctgcatactacgacaagcttttggatgaattcccagaattaatgtcaatggaagacccatacgacgaaaacgatgttgaaggtatggttaagtttactgcaactcacaaggaccgtatccaaatcgttcttgacgacttcatttgtactaacccagcacttttgaagaaggctatcaaggaaggtgcaggtaacgcttcattaatcaagttgaaccaaattggtactgttactgaaactcttgaaactatccgtatgtcacgtaagaatggttacaacactatgatttcacaccgttcaggtgaaactggtgacacattcatcgctgacttggcagttgctataaacggtggtcaacttaagaccggtgctccagctcgttcagaacgtgttgaaaagtacaaccgcttacttgaaatcgaagaagaacttggcaagggcgaacgtcttgcattcttcccagatgatgttgaccacgat

SEQ ID NO: 344 - protein, 428 aa, Lactobacillus acidophilus
MLKSVIENVHALEIFDSRGNPTVEVHVTLSNGVVGKAEVPSGASTGENEAVELRDGGSRLGGKGVSKAVNNVNTEINDALKGMDPFDQPKIDQTMIDLDGTPNKGRLGANAILGVSMATAVAAANANRQPLYRYLGGIDLEMPQTFHNVINGGEHADNGIDIQEFMITPIAKTSFRDGFEKIVNVYHTLKKVLEDMGYETGLGDEGGFAPNMKNSEEALKALHESIIKAGYKPGEDIGIACDCAASYFYNKEDGKYHLEGKVLTDDELAAYYDKLLDEFPELMSMEDPYDENDVEGMVKFTATHKDRIQIVLDDFICTNPALLKKAIKEGAGNASLIKLNQIGTVTETLETIRMSRKNGYNTMISHRSGETGDTFIADLAVAINGGQLKTGAPARSERVEKYNRLLEIEEELGKGERLAFFPDDVDHD

SEQ ID NO: 345 - DNA, 1188 bp, Lactobacillus acidophilus
  CDS (1)...(1188)
  misc_feature (0)...(0): ORF 845; ef-tu
atggcagaaaaagaacattacgttagaactaagccacacgtaaacattggtactatcggtcacgttgaccacggtaagaccactttaactgcggctattactactgttttagctgaaaagggattagctaaggctgaagattactcacaaatcgatgctgcacctgaagaaaaggaacgtggtatcactattaacaccgcccacgtagaatacgaaactgaaaatcgtcactacgctcacatggacgctccaggccacgccgactacatcaagaacatgattaccggtgcggctcaaatggatggtgctatcttagttgttgctgcaactgatggtcctatgccacaaactcgtgaacacattttgcttgctcgtcaagttggtgttaactacatcgtagtattcttgaacaagtgcgatttagttgacgacccagaattgatcgacttggttgaaatggaagttcgtgacttgttgactgaatacgattaccctggtgatgatattccagttgttcgtggttcagcattaaaggctttacaaggtgacaaggaagctcaagaccaaatcatgaagttgatggacattgttgatgaatacatcccaactccagaacgtcaaactgacaagccattcttgatgccagttgaagacgtattcactatcactggtcgtggtactgttgcttcaggtcgtatcgaccgtggtactgttaaggtcggtgacgaagttgaaatcgttggtttggtagataaagttcttaagtcagttgttactggtttggaaatgttccacaagactttggacttaggtgaagccggcgataacgttggtgtattgcttcgtggtgttgaccgtgatcaagttgttcgtggtcaagtattggctgcacccggctcaatccaaactcataagaagtttaaggcacaagtttatgttttgaagaaggacgaaggtggtcgtcacactccattcttctcagactaccgtccacaattctacttccacaccactgatattactggtgaaattgaattgccagaaggtactgaaatggttatgcctggtgataacactgaattcactgttactttgatcaagccagctgccatcgaaaagggtactaagttcaccatccgtgaaggtggtcgtaccgttggtgccggtcaagttactgaaatccttgac

SEQ ID NO: 346 - protein, 396 aa, Lactobacillus acidophilus
MAEKEHYVRTKPHVNIGTIGHVDHGKTTLTAAITTVLAEKGLAKAEDYSQIDAAPEEKERGITINTAHVEYETENRHYAHMDAPGHADYIKNMITGAAQMDGAILVVAATDGPMPQTREHILLARQVGVNYIVVFLNKCDLVDDPELIDLVEMEVRDLLTEYDYPGDDIPVVRGSALKALQGDKEAQDQIMKLMDIVDEYIPTPERQTDKPFLMPVEDVFTITGRGTVASGRIDRGTVKVGDEVEIVGLVDKVLKSVVTGLEMFHKTLDLGEAGDNVGVLLRGVDRDQVVRGQVLAAPGSIQTHKKFKAQVYVLKKDEGGRHTPFFSDYRPQFYFHTTDITGEIELPEGTEMVMPGDNTEFTVTLIKPAAIEKGTKFTIREGGRTVGAGQVTEILD

SEQ ID NO: 347 - DNA, 2397 bp, Lactobacillus acidophilus
  CDS (1)...(2397)
  misc_feature (0)...(0): ORF 600; xylulose-5-phosphate/fructose phosphoketolase
atgacagttaattacgattccaaagattacttaaagagcgttgacgcatattggcgtgcagctaattatttgtcagttggacaattatttttaatgaaaaatccgttgttaaagaaacctttaacagctgaagatgtaaaacctaagccaatcggtcactggggtactattgctccacaaaactttatttatgctcacttaaatcgtgcgcttaaaaaatatgacttggatatgttctatattgaaggttcaggtcacggtggccaagtgatggtttcaaattcatatcttgatggttcatatactgaacgttatccagaaattacccaagatgaaaagggtatggctaaattgtttaagcgctttagtttcccaggtggtgtagcttctcacgctgctcctgaaactccaggttctattcatgaaggtggggaattaggatacgcactttcacatggggtaggtgctattttagacaatccagatgtaattgctgccgttgaaattggtgatggtgaagcagaaactggtccacttgcagctagctggttcagtgacaagtttattaatccaattaaggatggtgcagttttaccaattcttcaaattaatggtttcaagatttctaacccaactatcgtttcaagaatgagcgatgaagaattaactgaatacttccgtggcatgggttgggatccgcactttgtttcagtatttaagggtggccgctttgacggtgaaaaggatccaatgcaagtccacgaagaaatggctaaaaccatggacgaagtaattgaagaaattaaggctattcaaaagcatgctcgtgaaaataatgatgctactttgccacattggccattgattatcttccaatgtccaaagggctggaccggtccaaagaaggatcttgacggcaatccaattgaaaactcatttagagcacaccaaattccaattcctgtctcacaatacgatatgaaacatgttgatatgttgactgattggcttgaaagttataagccaaacgaattattcaacgaagatggttcaccaaaggaaattgttactgaaaacactgctaagggtgatcaacgtatggcaatgaatccgatcactaatggtggtaaggatcctaaacgattgaacctaccagattatcgcaactttgcacttaagtttgacaagccaggttcagttgaagcacaagacatggttgaatgggctaaatatttaaacgaagttgctaaacttaacccaactactttccgtggctttggtcctgatgaatctaaatcaaaccgtttatttaaacttttagatgatcaaaagcgtcaatgggaacctgaagttcatgaaccaaatgatgaaaacttggcaccaagtggccgcgttatcgattcacaattatcagaacaccaagacgaaggcttccttgaaggctacgttttaactggtcgtcacggcttctttgcaacctacgaagcatttggtcgtgtagtagattcgatgcttactcaacatatgaagtggcttagaaaagctaaagaacaatattggcgtcatgattatccatcacttaactttgttgctacttcaacagtattccaacaagatcacaatggttacactcaccaagatccaggcattttaactcacttatatgaaaagaatcgtccagatttagttcatgaatacttgccatcagatactaatactttacttgctgtaggtaacaaggcatttactgatcgtgaatgtattaatgttttagtaacttcaaagcaacctcgtccacaatggttctcaattgaggaagcacaaaagttagttgataaaggtttaagttacattgattgggcttcaactgataaaggtgtaaaaccagatattgtctttgcttcaacagaaactgaaccaacaattgaaactttggcagcaattgatattttgcatgacaagttcccagatcttaagattcgctacattaacgtaattgatgtgatgaaattaatgtcaccaaaggacaataagaatggtatttctgatgaagaatttgatcgcttattcccaaaggacgttcctgtaatctttgcatggcacggctacaagagtatgatggaatcaatttggtttgcacgtaaccgtcataatgtacatattcactgctacgaagaaaacggtgatattactaccccatttgatatgcgtgttttgaaccaccttgacagatttgatcttgccaaagatgctgttgaaagtgttgataaattgaagggcaagaacgctgactttatcagtcatatggatgacttgcttgaaaagcaccaccaatacattcgtgataatggtaaagatatgccagaagttactgaatggaagtggaagggcttgaag

SEQ ID NO: 348 - protein, 799 aa, Lactobacillus acidophilus
MTVNYDSKDYLKSVDAYWRAANYLSVGQLFLMKNPLLKKPLTAEDVKPKPIGHWGTIAPQNFIYAHLNRALKKYDLDMFYIEGSGHGGQVMVSNSYLDGSYTERYPEITQDEKGMAKLFKRFSFPGGVASHAAPETPGSIHEGGELGYALSHGVGAILDNPDVIAAVEIGDGEAETGPLAASWFSDKFINPIKDGAVLPILQINGFKISNPTIVSRMSDEELTEYFRGMGWDPHFVSVFKGGRFDGEKDPMQVHEEMAKTMDEVIEEIKAIQKHARENNDATLPHWPLIIFQCPKGWTGPKKDLDGNPIENSFRAHQIPIPVSQYDMKHVDMLTDWLESYKPNELFNEDGSPKEIVTENTAKGDQRMAMNPITNGGKDPKRLNLPDYRNFALKFDKPGSVEAQDMVEWAKYLNEVAKLNPTTFRGFGPDESKSNRLFKLLDDQKRQWEPEVHEPNDENLAPSGRVIDSQLSEHQDEGFLEGYVLTGRHGFFATYEAFGRVVDSMLTQHMKWLRKAKEQYWRHDYPSLNFVATSTVFQQDHNGYTHQDPGILTHLYEKNRPDLVHEYLPSDTNTLLAVGNKAFTDRECINVLVTSKQPRPQWFSIEEAQKLVDKGLSYIDWASTDKGVKPDIVFASTETEPTIETLAAIDILHDKFPDLKIRYINVIDVMKLMSPKDNKNGISDEEFDRLFPKDVPVIFAWHGYKSMMESIWFARNRHNVHIHCYEENGDITTPFDMRVLNHLDRFDLAKDAVESVDKLKGKNADFISHMDDLLEKHHQYIRDNGKDMPEVTEWKWKGLK

SEQ ID NO: 349 - DNA, 1509 bp, Lactobacillus acidophilus
  CDS (1)...(1509)
  misc_feature (0)...(0): ORF 776; ATP synthase alpha subunit
ttgagcattaaagcggaagaaattagctccttgatcaagcaacaacttgaacattacgatgataagctcgatatcaacgaagttggtgttgtaacttatgttggtgatggtatcgcccgagctcacggactagatgatgtattgtctggtgagttattaaaatttgataacggttcatttggtattgctcaaaaccttgaatcaaatgatgttggtatcattattttaggtcaatttgacaatattcgtgaaggtgaccgtgttcaaagaactggtcgaatcatggaagttcctgttggtgacgccttaatcggtagagtagttaacccattgggtcaaccagtggacggtttaggtgaaattaagtctgacaagactcgtcctattgaagctaaagctccaggtgttatggaccgtcaatcagttaatcaaccacttcaaactggtattaaggctattgatgccttagttcctattggtcgtggtcagcgtgaattgattattggtgaccgtaagactggtaagactagtttggctattgatactatccttaatcaaaaaggacaagacgtaatttgtatttacgttgctattggtcaaaaggaatcaaccgttagaactcaagtagaaactttaaagcgttttggcgcaatggattacactattgttgttgaagcgggcccaagcgaaccagctcctatgctttatattgcaccatatgctggtaccgcaatgggtgaagaatttatgtacaatggcaaggatgtattgatcgtatttgacgacctatccaagcaagctgttgcttaccgtgaactttccttgcttctccgtcgtccgcctggtcgtgaagcttatccaggtgacgtcttctacttgcactcacgtttacttgaacgtagtgctaagttaagtgacaaacttggtggtggatcattgacagctttgccaattattcaaactgaagccggagatatttctgcatatattccaaccaacgtaatttcaattactgacgggcagattttcttgcaaagtgatttattctttgctggtactcgtccagctattgacgctggtaactcagtttctcgtgttggtggtaatgctcagatcaaggcaatgaagaaggttgctggtactttacgtactgaccttactgcttatcgcgaacttgaaagtttcgcccaatttggtagtgatcttgatcaagcaactcaagctaagcttaatagaggtcaaagaactgttgaagttttgaagcaaccacttcatgatccaattcctgtagaaaagcaagttttaattctttatgctttgactcatggctatcttgatgctattccagtcgaagacattagtcgtttccaaaatgaattgtttgataattttgatagcagtcatgctgatttgcttaagacaattcgtgaaaccggtaaattaccagatgacaaggaattatcagcagctattgaggaattcagtgaaagctttacaccaagtgaaaaa

SEQ ID NO: 350 - protein, 503 aa, Lactobacillus acidophilus
MSIKAEEISSLIKQQLEHYDDKLDINEVGVVTYVGDGIARAHGLDDVLSGELLKFDNGSFGIAQNLESNDVGIIILGQFDNIREGDRVQRTGRIMEVPVGDALIGRVVNPLGQPVDGLGEIKSDKTRPIEAKAPGVMDRQSVNQPLQTGIKAIDALVPIGRGQRELIIGDRKTGKTSLAIDTILNQKGQDVICIYVAIGQKESTVRTQVETLKRFGAMDYTIVVEAGPSEPAPMLYIAPYAGTAMGEEFMYNGKDVLIVFDDLSKQAVAYRELSLLLRRPPGREAYPGDVFYLHSRLLERSAKLSDKLGGGSLTALPIIQTEAGDISAYIPTNVISITDGQIFLQSDLFFAGTRPAIDAGNSVSRVGGNAQIKAMKKVAGTLRTDLTAYRELESFAQFGSDLDQATQAKLNRGQRTVEVLKQPLHDPIPVEKQVLILYALTHGYLDAIPVEDISRFQNELFDNFDSSHADLLKTIRETGKLPDDKELSAAIEEFSESFTPSEK

SEQ ID NO: 351 - DNA, 273 bp, Lactobacillus acidophilus
  CDS (1)...(273)
  misc_feature (0)...(0): ORF 970; DNA-binding protein II HB
atggcaaataaagctgaattagtttctgaagttgcttcaaagactaagttgaccaagaaagaagttgctgctgcagtagatgctatctttggctcaattcaagacaatcttgctaagggtgaaaaggtacaattaatcggttttggtacttttgaagtacgtcaccgtgctgcacgtaaaggccgcaacccacaaactggtgatgaaatcgaaatcccagcaagtgaagtacctgcatttaagccaggtaaggctcttaaggaagctgttaag

SEQ ID NO: 352 - protein, 91 aa, Lactobacillus acidophilus
MANKAELVSEVASKTKLTKKEVAAAVDAIFGSIQDNLAKGEKVQLIGFGTFEVRHRAARKGRNPQTGDEIEIPASEVPAFKPGKALKEAVK

SEQ ID NO: 353 - DNA, 1209 bp, Lactobacillus acidophilus
  CDS (1)...(1209)
  misc_feature (0)...(0): ORF 699; phosphoglycerate kinase
atggctaaattaatcatttcagacctcgacgttaaaggtaaaaaagttttagtacgtgtagactttaatgttcctattaaagatggcgttattggtgatgataaccgtatcgttgctgcacttcctactattaagtacattattgaacatggtggtaaggcaattttgcttagccacttaggtcgtgtaaagtcagatgctgataagaaggaattgtcattgaagccagttgctgaacgtttaagcgaacttcttgacaagcctgtaacttttgtaccatcaaacgaaggtaaagaagttgaagaagcaatcgacaacatgaaagacggagatgttgttgttcttgaaaacactagattccaagatatcgacaacgatttcggtaagcgtgaatcaggtaacgatccaaaacttggcgaatactgggcaagtcttggcgatatctttgtaaacgatgctttcggtactgcacacagaagtcacgcttcaaacgttggtattgcaaccgctatgaaggaaaatggtaagcctgctgcagctggttacttacttgaaaaggaaattaagtacttaggtgacgccgttgataatcctgtacacccatttgttactattttgggtggtgctaaggtttcagacaagatcggtgttatcgaaaacttgattcctaagtcagatcacatcttaattggtggtggtatggcttacacattcttagctgctcaaggtcacaagattggtaaatcattatttgaagctgataaggttgatcttgctaaggaattgcttgaaaaggctggcgacaagatcgttcttccagttgacaacgtagctgcaactgaattctcaaacgatgcttcacgtgaagttgttggtgacgacattcctgataatatgatgggtcttgacattggtcctaagactattgctaagtttaaggacatcttaaaggatgctaagactgttgtttggaatggaccaatgggtgctttcgaaatgcctaactttgctgaaggtactttagaagtaggtcgtgctttggcaaaccttactgacgcaactactattatcggtggtggtgactcaactgctgctgctaagcaattgggtatcgcacctaagattagccacatttcaactggtggtggtgcttcacttaactaccttgaaggtaaagtattgccaggtatcgcttgcgtttcagacaag

SEQ ID NO: 354 - protein, 403 aa, Lactobacillus acidophilus
MAKLIISDLDVKGKKVLVRVDFNVPIKDGVIGDDNRIVAALPTIKYIIEHGGKAILLSHLGRVKSDADKKELSLKPVAERLSELLDKPVTFVPSNEGKEVEEAIDNMKDGDVVVLENTRFQDIDNDFGKRESGNDPKLGEYWASLGDIFVNDAFGTAHRSHASNVGIATAMKENGKPAAAGYLLEKEIKYLGDAVDNPVHPFVTILGGAKVSDKIGVIENLIPKSDHILIGGGMAYTFLAAQGHKIGKSLFEADKVDLAKELLEKAGDKIVLPVDNVAATEFSNDASREVVGDDIPDNMMGLDIGPKTIAKFKDILKDAKTVVWNGPMGAFEMPNFAEGTLEVGRALANLTDATTIIGGGDSTAAAKQLGIAPKISHISTGGGASLNYLEGKVLPGIACVSDK

SEQ ID NO: 355 - DNA, 516 bp, Lactobacillus acidophilus
  CDS (1)...(516)
  misc_feature (0)...(0): ORF 8; single-stranded DNA-binding protein
atgattaatagagttgtacttgttggccgattaacacgtgatcctgaattgcgtactactggaagtggaatttcggtagctacgtttactcttgctgttgaccgtcaatttacaaatagtcagggtgagagaggcgcagactttatcagctgtgtaatctggagaaaggctgcggaaaacttctgtaactttacttcaaaaggttcattagttggtattgatggccgtattcaaaccagaagctatgacaataaagatgggcaacgagtatatgtaactgaagttgttgttgataacttctcattacttgaatcacgtaaggatcgtgaagcccgcggtcaaagtggtggatatacaccaaataatggaaatattaacaatcaacctgctaataatttccaaaataatggtggatcacaaaataatccacagattaataacaatcaaagttcttcacaagatccatttgctggatcaggtgatactattgatatttctgatgatgatcttccattc

SEQ ID NO: 356 - protein, 172 aa, Lactobacillus acidophilus
MINRVVLVGRLTRDPELRTTGSGISVATFTLAVDRQFTNSQGERGADFISCVIWRKAAENFCNFTSKGSLVGIDGRIQTRSYDNKDGQRVYVTEVVVDNFSLLESRKDREARGQSGGYTPNNGNINNQPANNFQNNGGSQNNPQINNNQSSSQDPFAGSGDTIDISDDDLPF

SEQ ID NO: 357 - DNA, 948 bp, Lactobacillus acidophilus
  CDS (1)...(948)
  misc_feature (0)...(0): ORF 1468; beta-galactosidase small subunit
atggcttacacaaataatttacaaatcatctatggtgatgccactttaggaatcactggtaaaaacttccattatcttttcagctacgaacgaggtgggttagaatcactcaacatcaataacaaagaatggttatatcgtgtgccgacccctactttctggcgagctactaccgataatgatcgaggtaatggctttaatttaaaggcatctcaatggctcggtgctgatatgtttactaaatgcactaaaatcgaattaaaggtagatgaccgacaattcgacgaacttccaattgctccaattaataatcaattcagtaatcatgaatatgctgaccatgttcaaattgcgttttggtatcaaactctaactaatccagcaactgacgttaaaatcatttataatattgataatactggttgtattaatatagtcatgcattattttggtaaaaaaggattgccaccattaccagtgattggaatgcgtttcatcatgccaactgctgcaactggctttgactacgaaggactttcgggggaaacttatcctgaccgaatggctggtgcaaaagaaggaaaattccatgttgatggcttaccagtaactaaatatttagtaccacaagaaaacgggatgcatatgcaaactaaggcactcaaaatcactcgttcttctactttaaataatgctgatcaagaaagtgaatttagtctaaagcttaagcaagataaacaaccgtttaattttagttgtttaccctacactgctgaagaattagaaaatgctactcatctcgaggaattaccacttgctcgcagaactgtgttagttattgctggagctgtgcgcggcgttggtggtatcgacagctggggtgctgatgttgaaaagcaatatcacattaatcctgaaaaagactacgaattttctttcaatcttaat

SEQ ID NO: 358 - protein, 316 aa, Lactobacillus acidophilus
MAYTNNLQIIYGDATLGITGKNFHYLFSYERGGLESLNINNKEWLYRVPTPTFWRATTDNDRGNGFNLKASQWLGADMFTKCTKIELKVDDRQFDELPIAPINNQFSNHEYADHVQIAFWYQTLTNPATDVKIIYNIDNTGCINIVMHYFGKKGLPPLPVIGMRFIMPTAATGFDYEGLSGETYPDRMAGAKEGKFHVDGLPVTKYLVPQENGMHMQTKALKITRSSTLNNADQESEFSLKLKQDKQPFNFSCLPYTAEELENATHLEELPLARRTVLVIAGAVRGVGGIDSWGADVEKQYHINPEKDYEFSFNLN

SEQ ID NO: 359 - DNA, 645 bp, Lactobacillus acidophilus
  CDS (1)...(645)
  misc_feature (0)...(0): ORF 1388; cellobiose phosphotransferase
atgactaaaattgctgtattaggtgctagtggacaaattgctaagttggcagaagaatttttcttaaaggatgcagataacgaattgatcttgttcttgcgtcatcctaacaagttagacaagtctgaaatcgatgaaaatcgtgaaaagattattgtgggggatgcaagtaaagtagatgaagttgctgcggctattaagggcgtcgaccttgtatatgctaacttagctggtggtaacattgaagatcaagctaaagcagtggtaaaggcgatggatcgagatggcattaagcgtcttatctggatttcttcattaggtgtatatgatgaagttcctggtaagtttggtgaatggaacaagaatatcttaggttcatatctcaccacttatcgtgctgccgccgatgtgattactgctagtgatttggactacacaattattcgtcctgcatggcttactaataaagatgaagtagattatgaagttactcgtggcgcacatactgcatttaagggtactgaggtatcacgtaagagtgtagcaagttacatcaatgacttggttaaagatccaagtaaggatgcccgtggtaacattggacttaacaagccaaatactgatggcgataaaccagcttggtat

SEQ ID NO: 360 - protein, 215 aa, Lactobacillus acidophilus
MTKIAVLGASGQIAKLAEEFFLKDADNELILFLRHPNKLDKSEIDENREKIIVGDASKVDEVAAAIKGVDLVYANLAGGNIEDQAKAVVKAMDRDGIKRLIWISSLGVYDEVPGKFGEWNKNILGSYLTTYRAAADVITASDLDYTIIRPAWLTNKDEVDYEVTRGAHTAFKGTEVSRKSVASYINDLVKDPSKDARGNIGLNKPNTDGDKPAWY

SEQ ID NO: 361 - DNA, 903 bp, Lactobacillus acidophilus
  CDS (1)...(903)
  misc_feature (0)...(0): ORF 1201; GTP-binding protein Era
atggaagaaaaagaatttaaatctggcttcgttgccttagttggccgtcctaatgttggtaaatcaacattgatgaattatttagtcggtcaaaaagtggcgattacgtcaaataaacctcagacaacgagaaatcgtatctcgggtatatatacttcagatagaatgcaagttatttttgttgatacaccgggaatctttaaacctcattcaaaacttgacgactatatggataaagctagtttatctagtttaaatgatgttgatctagttttattcatggttgaacctgaggatatgggtaaaggtgaccaatatattgctgacttgctcaaagaagttaaagttccagtatttttggtaattaataaggttgatcaaattcatcctaataagttattaccgattatggattcataccataaacttgatggctttaaagaaatactaccgatttctgctactcaaggcattggtattgatgatttgctcaatacaatctataagtatttaccagcaggaccacaatattatgatgcagatcagatcacagatcgtcctgaatattttgtggttgcagaacttattcgagaacaaattttacgacttacttctcaagaagttccacatgctactgcagttgtagtcgatcaaatgaataagcatcaaaatggtaaattagttattgaagcaactatttatgttgaaagagatggccaaaagggcattatcatcggcaagggtggtaagatgctcaagcaaatcggaattgattcacgtaaggaaattgaaagattacttggtgaaaaagtaaatttgcgtttatgggtaaaggttcaacataattggcgttcagatccaagtttcttgaaacaaattggttatgataaaaaagaacttgga

SEQ ID NO: 362 - protein, 301 aa, Lactobacillus acidophilus
MEEKEFKSGFVALVGRPNVGKSTLMNYLVGQKVAITSNKPQTTRNRISGIYTSDRMQVIFVDTPGIFKPHSKLDDYMDKASLSSLNDVDLVLFMVEPEDMGKGDQYIADLLKEVKVPVFLVINKVDQIHPNKLLPIMDSYHKLDGFKEILPISATQGIGIDDLLNTIYKYLPAGPQYYDADQITDRPEYFVVAELIREQILRLTSQEVPHATAVVVDQMNKHQNGKLVIEATIYVERDGQKGIIIGKGGKMLKQIGIDSRKEIERLLGEKVNLRLWVKVQHNWRSDPSFLKQIGYDKKELG

SEQ ID NO: 363 - DNA, 1284 bp, Lactobacillus acidophilus
  CDS (1)...(1284)
  misc_feature (0)...(0): ORF 935; histidyl tRNA synthetase
atgagagttcaaaaacctaagggtacagttgatattttgcctgatcaatctagttcatggcaaaaggtcgaagaaactgcaagaaatttcttcaatcgtgccaactatcgtgaaattcgcacaccaagttttgaaaactatgagattttctcacgttcaagtggtgacagttcagaaatcgttgaaaaacaaatgtatgatttcaatgataagggcggtcgtcacattgcccttcgtccagaaggtacagctggtgttgtacgtgcctatgttgaggataagatgtatgcacctgaagttgtaaaaccattcaatgtattctatatggaatcaacttttagatatgaaagaccgcaagcaggccgtcaacgtgaatttcatcaaattggtgtagaaagttttggctcaagtaatccactagctgatgttcaaactattatgatgggtcacgatttacttgctgaattaggtgttaaaaactaccagcttcacattaatactttaggtaatgagcaagtacgtaaagactatcatgatgcgttagtgaactactttactccagtgaaggatgaattatcagaagattcccaaagaagattacgtgataatccgcttcgtattttggattctaaagatgaacgtgataagaagttcttgccagatgcaccaaagatccgtgaattcttagatgatgatacaaagaataattttgaatcaattttgaagatgcttgatcaattaggtattgactatgtaattgatgatgatttagttcgtggtcttgactattatactggtgtaatttttgaatttatggtggaagataagagcctgtgggaatcagccactactattttaggtggtggtcgttatgatcacttagttgaagaattcaacggcccggcaactccagcagttggttttggtattggtgaagaaagattaatgcttgttttagaaaagcaaaatcctgctttgtttgaatcaaatagtatcgactttttcattgctaatattggtgaaggtactgctcaaaaggcaatcgaaattactagaagtttacgtaagcaaggctttgaagcagactttgacgtcaaccaaaagaagcttaaggctcaatttaaaaaagcagaccgcgatcatgctaagtatgtaattactttaggtgaaaaggaacttgaaaatggtgtcttaaatattaagcgtttgtctgatggtaaaacaatcgatttaagtcttgaagatatcaatgatatgagtaaagtaatgggagaattaaaggac

SEQ ID NO: 364 - protein, 428 aa, Lactobacillus acidophilus
MRVQKPKGTVDILPDQSSSWQKVEETARNFFNRANYREIRTPSFENYEIFSRSSGDSSEIVEKQMYDFNDKGGRHIALRPEGTAGVVRAYVEDKMYAPEVVKPFNVFYMESTFRYERPQAGRQREFHQIGVESFGSSNPLADVQTIMMGHDLLAELGVKNYQLHINTLGNEQVRKDYHDALVNYFTPVKDELSEDSQRRLRDNPLRILDSKDERDKKFLPDAPKIREFLDDDTKNNFESILKMLDQLGIDYVIDDDLVRGLDYYTGVIFEFMVEDKSLWESATTILGGGRYDHLVEEFNGPATPAVGFGIGEERLMLVLEKQNPALFESNSIDFFIANIGEGTAQKAIEITRSLRKQGFEADFDVNQKKLKAQFKKADRDHAKYVITLGEKELENGVLNIKRLSDGKTIDLSLEDINDMSKVMGELKD

SEQ ID NO: 365 - DNA, 609 bp, Lactobacillus acidophilus
  CDS (1)...(609)
  misc_feature (0)...(0): ORF 786; 30S ribosomal protein S4
atgtcaagatatacaggtccaagttggaagcgttcaagaagattaggtatctcactttcaggtactggtaaggaacttgcacgtcgtaactacgctccaggtcaacacggtcctaacagccgtggtcgtttgtcagaatatggccaacaattacacgaaaagcaaaagttacgttggatgtacggtttaaacgaacgccaatttagaactttattcattcgcgctggtaagattcgtgaaggtcaacacggtattaacttcatgatcttgcttgaacgccgtttagacagtattgtttaccgtctcggtttagctactactagagaacaagctagacaattagttaaccacggtcacatcactgttgatggcaagcgtgttgacattccttcatacgaagtcagtgttggtcaaactattggcttgaaggataagtcaaagaacttgcaacaaatcagggatgctttggaagcaactactgctcgtccatcatttgtttcatttgatgaaaacaagatggaaggtactcttgtacgtttaccagaacgtgacgaaatggaaccagaaattgacgaatcactcgttgttgaatggtacaacaagttactt

SEQ ID NO: 366 - protein, 203 aa, Lactobacillus acidophilus
MSRYTGPSWKRSRRLGISLSGTGKELARRNYAPGQHGPNSRGRLSEYGQQLHEKQKLRWMYGLNERQFRTLFIRAGKIREGQHGINFMILLERRLDSIVYRLGLATTREQARQLVNHGHITVDGKRVDIPSYEVSVGQTIGLKDKSKNLQQIRDALEATTARPSFVSFDENKMEGTLVRLPERDEMEPEIDESLVVEWYNKLL

SEQ ID NO: 367 - DNA, 975 bp, Lactobacillus acidophilus
  CDS (1)...(975)
  misc_feature (0)...(0): ORF 892; bshA
atgtgtacatcaattatattcagtcccaaagatcattactttggtcgtaaccttgatttagaaattacttttggtcaacaagttgttattacgccacgcaattacacttttaaattccgtaagatgcccagtttaaaaaagcactatgcaatgattggtatctcattagatatggatgattatcccctatatttcgacgctacaaatgaaaaaggtttaggtatggccggactcaactatccaggaaatgctacatattatgaagaaaaagaaaataaagataatattgcttcctttgaattcatcccttggattttaggacagtgtagcactattagcgaagtaaaggatttacttagcagaatcaacatcgccgatttaaatttcagcgaaaaaatgcaagcctcctctcttcactggcttattgcagataaaacaggtacatcattagttgttgaaacagacaaagatggaatgcatatttatgataatccagttggctgcttaactaataatccacaatttccaaagcaattattcaatttaaataactatgctgacgtatctccaaaaatgcctaaaaataacttctcagataaagtaaatatggctggctacagccgtggattagggtctcacaacttaccaggtggaatggattctgaatcacgttttgtcagagtagctttcaataaatttaatgctccaattgctgaaaccgaagaagaaaatattgatacttacttccacattttacattcggttgaacaacaaaagggactggatgaagttggtccaaactcatttgaatatacaatttattctgatggaactaacttagacaaaggtattttctactacaccacttattcaaacaaacaaattaacgttgttgatatgaataaagaagatctagatagcagcaatttgatcacttatgatatgcttgataaaactaaatttaaccatcaaaac

SEQ ID NO: 368 - protein, 325 aa, Lactobacillus acidophilus
MCTSIIFSPKDHYFGRNLDLEITFGQQVVITPRNYTFKFRKMPSLKKHYAMIGISLDMDDYPLYFDATNEKGLGMAGLNYPGNATYYEEKENKDNIASFEFIPWILGQCSTISEVKDLLSRINIADLNFSEKMQASSLHWLIADKTGTSLVVETDKDGMHIYDNPVGCLTNNPQFPKQLFNLNNYADVSPKMPKNNFSDKVNMAGYSRGLGSHNLPGGMDSESRFVRVAFNKFNAPIAETEEENIDTYFHILHSVEQQKGLDEVGPNSFEYTIYSDGTNLDKGIFYYTTYSNKQINVVDMNKEDLDSSNLITYDMLDKTKFNHQN

SEQ ID NO: 369 - DNA, 975 bp, Lactobacillus acidophilus
  CDS (1)...(975)
  misc_feature (0)...(0): ORF 1078; bshB
atgtgtacatcaatttgttataatcctaacgatcattattttggtagaaatcttgactatgaaattgcttatggtcaaaaagtagtcattgtaccaagaaactacgaatttaagtatagagaaatgccctctcaaaagatgcattatgcttttatcggagtatctgtagttaatgatgattatccattattatgtgatgcaattaatgaaaaggggcttggtattgcaggattaaattttcaaggtcctaatcattactttcctaaaatcgaaggtaagaagaatattgcttcttttgaattaatgccatacttattaagtaattgtgaaaatactgacgatgttaaagaaatcttagataatgcaaatattttaaatattagcttttcagcaaattatcctgcagctgatttacattggattttaagtgataaagctggtaagagtatcgtagttgaatcaaccaattcaggtttacatatttatgataatccagtgaatgtcttaactaacaatcctgaatttccggatcaattaattaaattaagtgactacgccgacgttactccacataatcctaagaatacattggttcctaatgttgatcttaatctatatagtagaggcttaggtactcaccacttacctggtggaatggattctagctctcgatttgttaaggtagcttttgtcttggcacacactccacaaggaaaaaatgaagtggaaaatgttactaattatttccatattctgcattcagtagaacaacctgatggtttagatgaagtagaagataatcgctatgaatatactatgtatacagattgtatgaacttagataaaggtattttgtactttactacttatgacaataatcggattaatgcagtagatatgcataaagcagatttagattcagaagatttaatctgctacgatttgtttaagaaacaagatattgaatatatgaat

SEQ ID NO: 370 - protein, 325 aa, Lactobacillus acidophilus
MCTSICYNPNDHYFGRNLDYEIAYGQKVVIVPRNYEFKYREMPSQKMHYAFIGVSVVNDDYPLLCDAINEKGLGIAGLNFQGPNHYFPKIEGKKNIASFELMPYLLSNCENTDDVKEILDNANILNISFSANYPAADLHWILSDKAGKSIVVESTNSGLHIYDNPVNVLTNNPEFPDQLIKLSDYADVTPHNPKNTLVPNVDLNLYSRGLGTHHLPGGMDSSSRFVKVAFVLAHTPQGKNEVENVTNYFHILHSVEQPDGLDEVEDNRYEYTMYTDCMNLDKGILYFTTYDNNRINAVDMHKADLDSEDLICYDLFKKQDIEYMN

SEQ ID NO: 371 - DNA, 27 bp, Artificial Sequence
  CIRCE operator sequence
  misc_feature (10)...(18): n = A, C, T, or G
ttagcactcnnnnnnnnngagtgctaa

SEQ ID NO: 372 - DNA, 8 bp, Artificial Sequence
  'CRR' domain
  misc_feature (2)...(3): n = A, C, T, or G
  misc_feature (5)...(5): n = A, C, T, or G
  misc_feature (7)...(7): n = A, C, T, or G
cnncngng

SEQ ID NO: 373 - protein, 4 aa, Artificial Sequence
  Consensus sequence
  misc_feature (4)...(4): Xaa = any amino acid
CAAX

SEQ ID NO: 374 - protein, 5 aa, Artificial Sequence
  Zinc metalloprotease motif
  misc_feature (3)...(4): Xaa = any amino acid
HEXXH

SEQ ID NO: 375 - protein, 4 aa, Artificial Sequence
  ER retrieval signal
  misc_feature (3)...(4): Xaa = any amino acid
KKXX

SEQ ID NO: 376 - protein, 8 aa, Artificial Sequence
  Walker A box consensus sequence
  misc_feature (1)...(1): Xaa = Gly or Ala
  misc_feature (2)...(5): Xaa = any amino acid
  misc_feature (8)...(8): Xaa = Thr or Ser
XXXXXGKX

SEQ ID NO: 377 - protein, 11 aa, Artificial Sequence
  Consensus sequence for recognition of glutamate
FHLVFFLLLGG

SEQ ID NO: 378 - DNA, 25 bp, Artificial Sequence
  Primer for bshA
aaagtcgacgaaaaggggcttggta

SEQ ID NO: 379 - DNA, 25 bp, Artificial Sequence
  Primer for bshA
aagaattcccatcaggttgttctac

SEQ ID NO: 380 - DNA, 26 bp, Artificial Sequence
  Primer for bshB
aggatccagttagttccatcagaata

SEQ ID NO: 381 - DNA, 27 bp, Artificial Sequence
  Primer for bshB
tataagcttggtatggccggactcaac

That which is claimed:

1. An isolated nucleic acid molecule comprising a nucleotide sequence encoding a polypeptide having at least 95% amino acid sequence identity to the full length amino acid sequence of SEQ ID NO: 146, wherein said nucleic acid molecule encodes the polypeptide having histidine kinase activity.

2. The isolated nucleic acid molecule of claim 1, wherein said nucleic acid molecule comprises SEQ ID NO:145.

3. The isolated nucleic acid molecule of claim 1, wherein said nucleic acid molecule encodes a polypeptide having the amino acid sequence set forth in SEQ ID NO:146.

4. An isolated plasmid comprising a nucleotide sequence that encodes a polypeptide having at least 95% amino acid sequence identity to the full length amino acid sequence of SEQ ID NO: 146, wherein said polypeptide has histidine kinase activity.

5. The isolated plasmid of claim 4, further comprising a nucleic acid molecule encoding a heterologous polypeptide.

6. A microbial host cell comprising a heterologous nucleic acid molecule comprising a nucleotide sequence that encodes a polypeptide having at least 95% amino acid sequence identity to the full length of the amino acid sequence of SEQ ID NO: 146, wherein said nucleic acid molecule encodes the polypeptide having histidine kinase activity.

7. The microbial host cell of claim 6 that is a bacterial cell.

8. The microbial host cell of claim 6, wherein said nucleic acid molecule comprises SEQ ID NO: 145.

9. The microbial host cell of claim 6, wherein said nucleic acid molecule encodes a polypeptide having the amino acid sequence set forth in SEQ ID NO: 146.

10. The microbial host cell of claim 6, wherein said heterologous nucleic acid molecule is in a plasmid.

11. A method for producing a polypeptide, comprising culturing a cell comprising a heterologous polynucleotide encoding said polypeptide under conditions in which a nucleic acid molecule encoding the polypeptide is expressed, said polypeptide comprises the amino acid sequence having at least 95% sequence identity to the full length amino acid sequence of SEQ ID NO: 146, wherein said polypeptide retains histidine kinase activity.

* * * * *

UNITED STATES PATENT AND TRADEMARK OFFICE
CERTIFICATE OF CORRECTION

PATENT NO. : 7,608,700 B2
APPLICATION NO. : 11/074176
DATED : October 27, 2009
INVENTOR(S) : Klaenhammer et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 610 days.

Signed and Sealed this

Twelfth Day of October, 2010

David J. Kappos

*Director of the United States Patent and Trademark Office*